United States Patent
Peters et al.

(10) Patent No.: US 11,505,581 B2
(45) Date of Patent: Nov. 22, 2022

(54) ANTIGENS AND T CELL EPITOPES FROM COCKROACH AND METHODS OF MAKING AND USING SAME

(71) Applicant: La Jolla Institute for Allergy and Immunology, La Jolla, CA (US)

(72) Inventors: Bjoern Peters, La Jolla, CA (US); Alessandro Sette, La Jolla, CA (US)

(73) Assignee: La Jolla Institute for Allergy and Immunology, La Jolla, CA (US)

( * ) Notice: Subject to any disclaimer, the term of this patent is extended or adjusted under 35 U.S.C. 154(b) by 0 days.

(21) Appl. No.: 15/574,061

(22) PCT Filed: May 13, 2016

(86) PCT No.: PCT/US2016/032494
§ 371 (c)(1),
(2) Date: Nov. 14, 2017

(87) PCT Pub. No.: WO2016/183500
PCT Pub. Date: Nov. 17, 2016

(65) Prior Publication Data
US 2018/0291071 A1    Oct. 11, 2018

Related U.S. Application Data

(60) Provisional application No. 62/161,797, filed on May 14, 2015.

(51) Int. Cl.
| | | |
|---|---|---|
| *C07K 14/435* | (2006.01) | |
| *A61K 39/35* | (2006.01) | |
| *A61P 37/08* | (2006.01) | |
| *A61K 39/00* | (2006.01) | |
| *A61K 49/00* | (2006.01) | |
| *G01N 33/50* | (2006.01) | |

(52) U.S. Cl.
CPC ...... *C07K 14/43563* (2013.01); *A61K 39/001* (2013.01); *A61K 39/35* (2013.01); *A61K 49/0004* (2013.01); *A61K 49/0006* (2013.01); *A61P 37/08* (2018.01); *C07K 14/435* (2013.01); *G01N 33/5041* (2013.01); *G01N 2800/24* (2013.01)

(58) Field of Classification Search
CPC . C07K 14/43563; C07K 14/435; A61P 37/08; A61K 39/001; A61K 39/35; G01N 33/5041; G01N 2800/24
See application file for complete search history.

(56) References Cited

U.S. PATENT DOCUMENTS

| | | | |
|---|---|---|---|
| 5,869,288 A * | 2/1999 | Chapman | C07K 14/43563 435/320.1 |
| 2004/0058881 A1 * | 3/2004 | Humphreys | C07H 21/04 514/44 R |
| 2008/0233155 A1 * | 9/2008 | Moingeon | A61K 9/006 424/275.1 |
| 2010/0291145 A1 * | 11/2010 | Humphreys | A61K 39/385 424/208.1 |
| 2014/0140986 A1 * | 5/2014 | Santos | A61K 39/395 424/130.1 |

FOREIGN PATENT DOCUMENTS

| | | | | |
|---|---|---|---|---|
| WO | WO-2013166453 A2 * | 11/2013 | | A61K 39/0003 |
| WO | WO-2014006262 A1 * | 1/2014 | | A61K 38/45 |

OTHER PUBLICATIONS

Elie Dolgin, Nature Biotechnology vol. 34 No. 9 Sep. 2016, pp. 901-902 (Year: 2016).*
Papouchado et al., Tissue Antigens 2000: 55: 303-311 (Year: 2000).*
Wikipeida definition of "peptide" downloaded Nov. 23, 2020 from the internet, 10 pages, https://en.wikipedia.org/wiki/Peptide (Year: 2020).*
Oseroff (J Immunol 2012;189:679-688) (Year: 2012).*
Papouchado BG. Tissue Antigens. 2000 55:303-11 (Year: 2000).*
Arruda, K.L, et al., Recombinant Allergens for Diagnosis of Cockroach Allergy, Curr Allergy Asthma Rep., 2014, 14 (4):1-20.
Pomes, A., et al., Investigating cockroach allergens: aiming to improve diagnosis and treatment of cockroach allergic patients, Methods, 2014, 66(1): 75-85.

* cited by examiner

*Primary Examiner* — Fred H Reynolds
*Assistant Examiner* — Joseph Fischer
(74) *Attorney, Agent, or Firm* — Pillsbury Winthrop Shaw Pittman LLP

(57) ABSTRACT

The specificity of CD4+ TH responses of German cockroach (Bla g) antigens, and whether differences exist in magnitude or functionality as a function of disease severity, is disclosed. Also disclosed are novel German cockroach allergens and epitopes.

6 Claims, 7 Drawing Sheets
Specification includes a Sequence Listing.

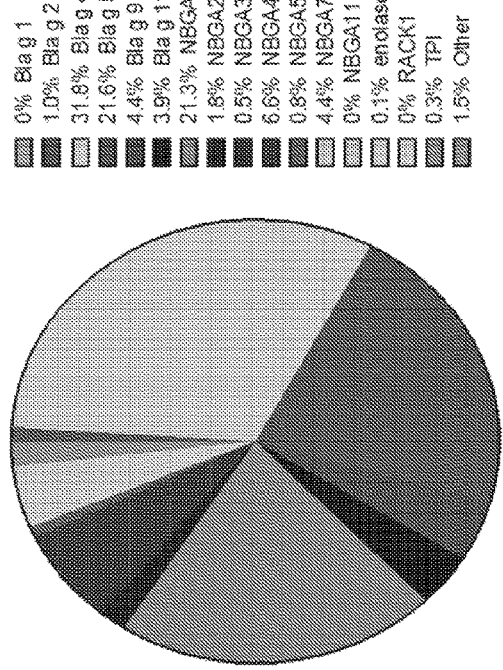
Fig. 6B Rhinitis
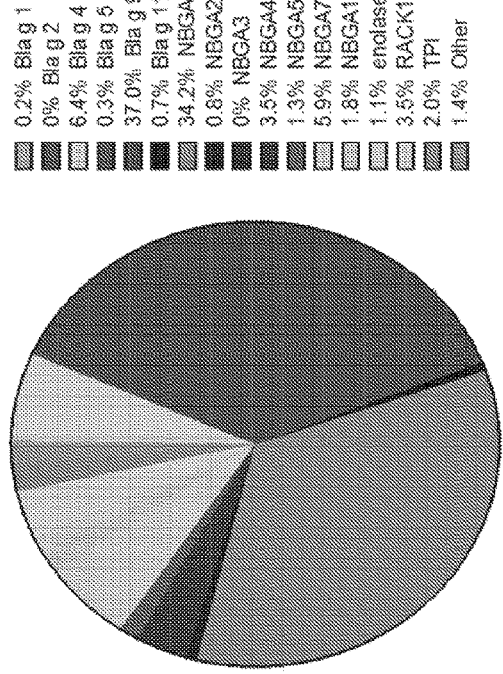
Fig. 6A Controls
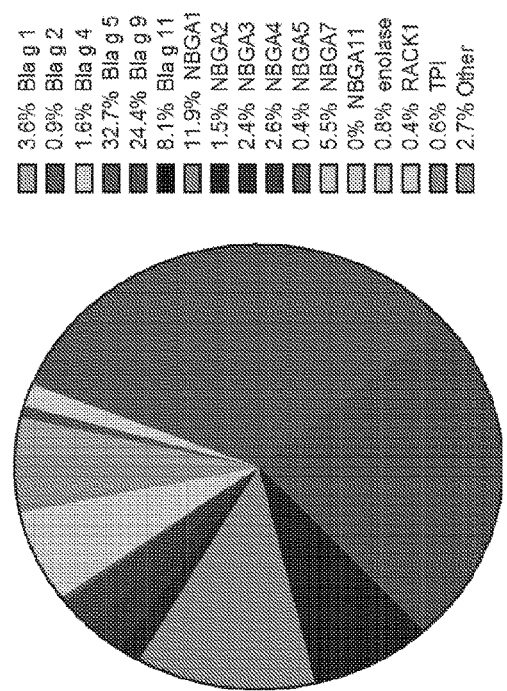
Fig. 6C Asthmatic

Asthmatic

AR

ANTIGENS AND T CELL EPITOPES FROM COCKROACH AND METHODS OF MAKING AND USING SAME

RELATED APPLICATIONS

This application is the National Phase of International Application No. PCT/US2016/032494, filed May 13, 2016 which designated the U.S. and that International Application was published under PCT Article 21(2) in English, and claims priority to U.S. Provisional Patent Application No. 62/161,797 filed on May 14, 2015, entitled NOVEL ANTIGENS AND T CELL EPITOPES FROM COCKROACH AND METHODS OF MAKING AND USING THE SAME, naming Bjoern Peters and Alessandro Sette as inventors. The entire content of the foregoing applications are expressly incorporated herein by reference in their entirety, including all text, tables and drawings.

GOVERNMENT SUPPORT

This invention was made with government support under HHSN272200900052C/N01 and U19 AI100275 awarded by the National Institutes of Health. The government has certain rights in the invention.

SEQUENCE LISTING

The instant application contains a Sequence Listing which has been submitted electronically in ASCII format and is hereby incorporated by reference in its entirety. Said ASCII copy created on Nov. 14, 2017, is named "LIAI0454972_ST25.txt" and is 566 bytes in size.

SEQUENCE LISTING

The instant application contains a Sequence Listing which has been submitted electronically in ASCII format and is hereby incorporated by reference in its entirety. Said ASCII copy, created on Aug. 3, 2020, is named 051501-0454972_SL.txt and is 563,879 bytes in size.

FIELD OF THE INVENTION

The invention relates to Cockroach proteins, peptides, subsequences, portions, homologues, variants and derivatives thereof, and methods and uses and medicaments of such proteins, peptides, including methods of modulating an immune response, protecting a subject against or treating a subject for an allergic response, allergic disorder or allergic disease and inducing immunological tolerance to the allergen in a subject.

INTRODUCTION

The German cockroach (*Blattella germanica*; Bla g) is one of the most common indoor allergens among inner-city children and, as such, is a significant health problem worldwide[1,2]. In addition, Bla g allergies are strongly correlated to development of asthma, and there is evidence that early exposure to Bla g leads to increased Bla g sensitization and, in turn, increased asthma severity[1].

The humoral response to Bla g allergens has been subject to intense research. Indeed, the humoral IgE reactivity of sensitized individuals has been utilized to identify Bla g allergens. The allergens Bla g 1, 2, 3, 4, 5, 6, 7, 8, 9, and 11 all have established IgE reactivity from sensitized individuals[3-12], and several studies have established correlations of seroreactivity prevalence with the severity of Bla g allergies[2,13]. However, the cellular arm of the immunological response has been investigated only superficially, limited to few of the known Bla g allergens, and relatively few T cell Bla g antigens and epitopes have been identified[14,15].

A combined transcriptomic and proteomic approach was used to identify novel antigens and epitopes in Timothy grass (TG) allergy[16]. This approach greatly expanded the number of TG antigens recognized by T cell responses. Furthermore, it indicated that T cell reactivity is not necessarily limited to pollen recognized by IgE responses, and extends also to pollen proteins recognized by IgG responses, and proteins generally abundant in the pollen extract. Proteomic studies reported several novel Bla g proteins associated with IgE reactivity[11,17].

As mentioned above, while certain T cell epitopes from Bla g[14,15] have been reported to be characterized, a systematic analysis has not been undertaken, and little information exists regarding the relative immunodominance and breadth of responses. In other systems, such as for example TG pollen[16,18], and house dust mite[19], responses target a large breadth of epitopes, and each subject typically recognize multiple epitopes. However, it is also commonly noted that a few dominant epitopes account for a large fraction of the response[20].

T cell allergen specific responses are usually dominated by $T_H2$ type responses, with IL-5 secreted at the highest levels, followed by IL-13, IL-4, and IL-9[21,22], but involvement of different T helper subsets has also been reported. More recently, $T_H17$ cells have been described, particularly in the context of asthmatic reactions, as IL-17F has been reported in numerous asthmatic states[23,24]. $T_R1$ secreting IL-10 have been implicated in negative regulation of T cell allergic responses[25]. $T_H1$ IFNγ producing cells have been described, and a balance in $T_H1/T_H2$ polarization has been described as a potential key determinant in regulating allergic reactions[26]. Finally, recent studies have described $T_{FH}$ cells, associated with production of IL-21, as key regulators of isotype switch (including IgE)[27], but little data exist regarding IL-21 production in allergic responses.

Bla g allergies are associated with a wide range of clinical presentations, ranging from allergic rhinitis (AR) without asthmatic symptoms, to asthma of different severity, ranging from intermittent (IA), to mild, moderate (MMA), and severe (SA)[2,28.] However, associations of Bla g sensitization with allergies has focused primarily on IgE reactivity to whole Bla g extract or one or two individual allergens, although more recent studies have more thoroughly examined the prevalence of IgE reactivity in populations, if not relative titers[29]. Accordingly, little data is available to assess whether differential disease severity is reflective or associated with differential magnitude, functionality, or antigen/epitope specificity at the level of T cell responses.

SUMMARY

As disclosed herein, the relative balance of different T helper functional subsets and response types in Bla g allergies was determined. T cell responses to the well-described Bla g allergens were characterized, and further a proteomic/transcriptomic approach was used to identify novel Bla g allergens and test whether there were additional Bla g proteins targeted by T cell responses. The balance of $T_H1$, $T_H2$, $T_H17$, $T_R1$, and $T_{FH}$ (IFNγ, IL-5, IL-10, IL-17, and 11-21) epitopic responses to Bla g was determined, and whether distinct patterns of T cell subset responsiveness would be associated with different clinical presentations of Bla g allergy was tested.

$T_H$ responses were characterized in a cohort of adult Bla g sensitized subjects, either with (n=55) or without (n=17) diagnosed asthma, and non-sensitized controls (n=20). Responses were detected for ten known Bla g Allergens and for ten novel T cell responsive Bla g antigens. Responses of sensitized individuals regardless of asthma status were predominantly $T_H2$, and magnitude of responses was higher in patients with diagnosed asthma. Differences were noted in terms of the main allergen recognized. In asthmatic sensitized subjects Bla g 9 and 11 were immunodominant, while in contrast, non-asthmatic sensitized subjects respond preferentially to Bla g 4, and the novel proteomic-identified antigen NBGA5. Bla g 5 was dominantly recognized in both groups.

The data disclosed herein indicate that within cockroach-sensitized subjects, asthmatic and non-asthmatic individuals are associated with similarly polarized responses. Compared to non-asthmatics, asthmatic individuals are however associated with $T_H$ responses of higher magnitude and different allergen specificity.

In accordance with the invention there are provided novel Cockroach proteins and peptides, as well as methods and uses of and medicaments including such novel Cockroach proteins and peptides. Cockroach proteins and peptides disclosed herein include epitopes and allergens. Also disclosed herein are Cockroach subsequences, portions, homologues, variants and derivatives thereof, and methods and uses of and medicaments including such Cockroach proteins, peptides, subsequences, portions, homologues, variants and derivatives thereof.

In certain embodiments a Cockroach protein comprises, consists of or consists essentially of an amino acid sequence comprising, consisting of or consisting essentially of an amino acid sequence set forth in Tables 5-8, or a subsequence, portion, homologue, variant or derivative thereof or a subsequence, portion, homologue, variant or derivative thereof, or a combination thereof.

In particular embodiments of the invention there are provided proteins and peptides including, consisting of or consisting essentially of an amino acid sequence set forth in Table 5 or 6, or a subsequence, portion, homologue, variant or derivative thereof or a subsequence, portion, homologue, variant or derivative thereof, or a combination thereof.

In other particular embodiments of the invention there are provided proteins and peptides including, consisting of or consisting essentially of an amino acid sequence set forth as (SEQ ID NOs.: 1-23): TIPYYTKKFDEVVKA (SEQ ID NO: 1), ISDFRAAIANYHYDA (SEQ ID NO: 2), YFVAILDYLNHMAKE (SEQ ID NO: 3), VAISRYLGKQFGLSG (SEQ ID NO: 4), MIVDTISDFRAAIAN (SEQ ID NO: 5), DLVANQPNLKALREK (SEQ ID NO: 6), HDDRLGFLTFCPTNL (SEQ ID NO: 7), KNRTTIRGRTKFEGN (SEQ ID NO: 8), DRKMYWQFKMDKIQI (SEQ ID NO: 9), ALREKVLGLPAIKAW (SEQ ID NO: 10), IRGRTKFEGNKFTID (SEQ ID NO: 11), NDIEKRVPFSHDDRL (SEQ ID NO: 12), HMAKEDLVANQPNLK (SEQ ID NO: 13), VLEKLEAGFAKLAAS (SEQ ID NO: 14), NYAIVEGCPAAANGH (SEQ ID NO: 15), GIRIYVDVVLNQMSG (SEQ ID NO: 16), RWRQIFNMVGFRNAV (SEQ ID NO: 17), NIACLLHNKYDSTKS (SEQ ID NO: 18), NGGYLAAGKLTWADF (SEQ ID NO: 19), LNIFTNNLGRINTHV (SEQ ID NO: 20), KTPVLEIDGKQTHQS (SEQ ID NO: 21), PAYFKMNSPSLWKYN (SEQ ID NO: 22), PKSMLLNIFTNNLGR (SEQ ID NO: 23), or a subsequence, portion, homologue, variant or derivative thereof, or a combination thereof.

In further particular embodiments of the invention there are provided proteins and peptides including, consisting of or consisting essentially of an amino acid sequence set forth as (SEQ ID NOs.: 1-23): TIPYYTKKFDEVVKA (SEQ ID NO: 1), ISDFRAAIANYHYDA (SEQ ID NO: 2), YFVAILDYLNHMAKE (SEQ ID NO: 3), VAISRYLGKQFGLSG (SEQ ID NO: 4), MIVDTISDFRAAIAN (SEQ ID NO: 5), DLVANQPNLKALREK (SEQ ID NO: 6), HDDRLGFLTFCPTNL (SEQ ID NO: 7), KNRTTIRGRTKFEGN (SEQ ID NO: 8), DRKMYWQFKMDKIQI (SEQ ID NO: 9), ALREKVLGLPAIKAW (SEQ ID NO: 10), IRGRTKFEGNKFTID (SEQ ID NO: 11), NDIEKRVPFSHDDRL (SEQ ID NO: 12), HMAKEDLVANQPNLK (SEQ ID NO: 13), VLEKLEAGFAKLAAS (SEQ ID NO: 14), NYAIVEGCPAAANGH (SEQ ID NO: 15), GIRIYVDVVLNQMSG (SEQ ID NO: 16), RWRQIFNMVGFRNAV (SEQ ID NO: 17), NIACLLHNKYDSTKS (SEQ ID NO: 18), NGGYLAAGKLTWADF (SEQ ID NO: 19), LNIFTNNLGRINTHV (SEQ ID NO: 20), KTPVLEIDGKQTHQS (SEQ ID NO: 21), PAYFKMNSPSLWKYN (SEQ ID NO: 22), PKSMLLNIFTNNLGR (SEQ ID NO: 23), or a combination of such amino acid sequences.

In additional particular embodiments of the invention there are provided proteins and peptides including, consisting of or consisting essentially of a subsequence, portion, homologue, variant or derivative of an amino acid sequence set forth as (SEQ ID NOs.: 1-23): TIPYYTKKFDEVVKA (SEQ ID NO: 1), ISDFRAAIANYHYDA (SEQ ID NO: 2), YFVAILDYLNHMAKE (SEQ ID NO: 3), VAISRYLGKQFGLSG (SEQ ID NO: 4), MIVDTISDFRAAIAN (SEQ ID NO: 5), DLVANQPNLKALREK (SEQ ID NO: 6), HDDRLGFLTFCPTNL (SEQ ID NO: 7), KNRTTIRGRTKFEGN (SEQ ID NO: 8), DRKMYWQFKMDKIQI (SEQ ID NO: 9), ALREKVLGLPAIKAW (SEQ ID NO: 10), IRGRTKFEGNKFTID (SEQ ID NO: 11), NDIEKRVPFSHDDRL (SEQ ID NO: 12), HMAKEDLVANQPNLK (SEQ ID NO: 13), VLEKLEAGFAKLAAS (SEQ ID NO: 14), NYAIVEGCPAAANGH (SEQ ID NO: 15), GIRIYVDVVLNQMSG (SEQ ID NO: 16), RWRQIFNMVGFRNAV (SEQ ID NO: 17), NIACLLHNKYDSTKS (SEQ ID NO: 18), NGGYLAAGKLTWADF (SEQ ID NO: 19), LNIFTNNLGRINTHV (SEQ ID NO: 20), KTPVLEIDGKQTHQS (SEQ ID NO: 21), PAYFKMNSPSLWKYN (SEQ ID NO: 22), PKSMLLNIFTNNLGR (SEQ ID NO: 23), or a combination of such subsequence, portion, homologue, variant or derivative amino acid sequences.

In still further particular embodiments of the invention, a composition or method excludes, or a protein or peptide is not identical to an amino acid sequence of any of (SEQ ID NOs.: 24-45): FETIVVTVDSLPEFK (SEQ ID NO: 24), LIDDVLAILPLDDLK (SEQ ID NO: 25), FAVATITHAELQRV (SEQ ID NO: 26), PLYKLVHVFINTQYA (SEQ ID NO: 27), GNQNFLTVFDSTSCN (SEQ ID NO: 28), ISSQYYIQQNGNLC (SEQ ID NO: 29), HFFIGDFFVDHYYSE (SEQ ID NO: 30), GEPIRFLLSYGEKDF (SEQ ID NO: 31), FLLSYGEKDFEDYRF (SEQ ID NO: 32), SMPFGKTPVLEIDGK (SEQ ID NO: 33), VAISRYLGKQFGLSG (SEQ ID NO: 34), ISDFRAAIANYHYDA (SEQ ID NO: 35), YFVAILDYLNHMAKE (SEQ ID NO: 36), HMAKEDLVANQPNLK (SEQ ID NO: 37), DLVANQPNLKALREK (SEQ ID NO: 38), ALREKVLGLPAIKAW (SEQ ID NO: 39), VLGLPAI- KAWVAKRP (SEQ ID NO: 40), EQISVLRKAFDAFDR (SEQ ID NO: 41), LRKAFDAFDREKSGS (SEQ ID NO: 42), EFVTLAAKFIIEEDS (SEQ ID NO: 43), EAMEKEL-REAFRLYD (SEQ ID NO: 44), or SGTVDFDEFMEMMTG (SEQ ID NO: 45).

In certain embodiments, a Cockroach protein or peptide modulates an anti-allergen immune response. In other certain embodiments, a Cockroach protein or peptide elicits, stimulates, induces, promotes, increases or enhances an anti-allergen immune response. In further certain embodiments, a protein or peptide decreases, reduces, inhibits, suppresses or disrupts an anti-allergen immune response. In particular aspects of the proteins and peptides described herein, an anti-allergen immune response is an anti-Cockroach allergen response.

In further certain embodiments, a protein or peptide elicits, stimulates, induces, promotes, increases or enhances immunological tolerance (desensitizes) of an allergen, for example, a Cockroach allergen such as a protein or peptide set forth in in Tables 5-8; or a subsequence, portion, homologue, variant or derivative thereof or a subsequence, portion, homologue, variant or derivative thereof, or a combination thereof; or an amino acid sequence set forth in Table 5 or 6; or a subsequence, portion, homologue, variant or derivative thereof or a subsequence, portion, homologue, variant or derivative thereof, or a combination thereof; or an amino acid sequence set forth in Table 6, or a subsequence, portion, homologue, variant or derivative thereof or a subsequence, portion, homologue, variant or derivative thereof, or a combination thereof.

In particular, an anti-allergen immune response is an anti-Cockroach allergen immune response. In particular embodiments, the allergen is a Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, or a NBGA (Novel Bla g antigen) protein, such as NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16), e.g. a Cockroach allergen/antigen set forth in Table 5.

In further particular embodiments, an anti-Cockroach allergen immune response is a T cell response, for example a Th2 immune (cell) response (e.g., memory T cell response). In additional particular embodiments, an anti-Cockroach allergen immune response is an IgG or IgE reactive antigen or allergen.

In certain aspects, immunological tolerance comprises enhancing or improving tolerance of an anti-Cockroach allergen, such as a T cell response, for example, decreases, reduces, inhibits, suppresses or disrupts a Th2 immune (cell) response (e.g., memory T cell response) against a Cockroach allergen, such as a response against a protein or peptide set forth in any of Tables 5-8, or a subsequence, portion, homologue, variant or derivative thereof. In further aspects, the anti-allergen immune response modulates (e.g., increases, induces, elicits or stimulates, or decreases, reduces, inhibits, suppresses or disrupts) production of a lymphokine or cytokine by a cell. Particular lymphokines and cytokines which may be modulated include, for example, IL-5 (interleukin-5), IL-4 (interleukin-4), IL-10 (interleukin-13), IL-13 (interleukin-13), IL-17 (interleukin-17) and IFN-γ (interferon-gamma).

Accordingly, in additional embodiments, a Cockroach protein or peptide elicits, stimulates, induces, improves, increases or enhances immunological tolerance of a subject to an allergen. In further particular embodiments, the Cockroach protein or peptide sequence, subsequence, homologue, or variant desensitizes, or elicits, stimulates, induces, improves, increases, or enhances immunological tolerance of a subject to a Cockroach allergen. Such Cockroach allergens to which immunological tolerance may be elicited, stimulated, induced, improved, increased, or enhanced include but are not limited to a protein or peptide set forth in any of Tables 5-8, and may include or consist of a Cockroach allergen/antigen set forth in Table 5, or a subsequence, portion, homologue, variant or derivative thereof.

T cell responses can be detected by an assay. For example, lymphokine, cytokine, IL-5 (interleukin-5), IL-4 (interleukin-4), IL-10 (interleukin-13), IL-13 (interleukin-13), IL-17 (interleukin-17) or IFN-γ (interferon-gamma) production can be detected by an immunoassay.IL-5, Il-4, IL-10, IL-13, IL-17 or IFN-γ production can be determined by contacting peripheral blood mononuclear cells (PBMC) with the protein or peptide followed by an immunoassay, for example.

In various aspects, a homologue or variant has at least 65% homology or identity (or more, e.g., 70%, 75%, 80%, 85%, 90%, 95%, (96%, 97%, 98%, 99% or more) to a Cockroach a protein or peptide set forth in any of Tables 5-8.

As disclosed herein, in certain embodiments proteins and peptides have a length in a range of about 5-10, 10-15, 15-20, 20-25, 25-30, 30-35, 35-40, 45-50, 50-60, 60-70, 70-80, 80-90, 90-100, 100-125, 125-150, 150-175, 175-200, 200-250, 250-300, or more amino acid residues. In other embodiments, proteins and peptides have a length in a range of up to 25 amino acids in length, or from about 7 to 20; 8 to 30; 8 to 25; 8 to 20; 9 to 30; 9 to 25; 9 to 20; 10 to 30; 10 to 25; 10 to 30 amino acid residues.

In particular aspects, a (sub)sequence is 7 to 30 amino acids in length and wherein at least 7 contiguous amino acids are at least 75% identical or homologous to at least 7 contiguous amino acids of said corresponding Cockroach a protein or peptide set forth in any of Tables 5-8.

In further particular aspects, a subsequence, homologue, or variant is: i. a peptide of up to 30 amino acids in length which comprises an amino acid sequence of a protein or peptide set forth in in any of Tables 5-8; or ii. a peptide of 7 to 30 amino acids in length which comprises a subsequence of at least 7 contiguous amino acids having at least 75% identity or homology to at least 7 contiguous amino acids of a protein or peptide set forth in any of Tables 5-8.

Cockroach proteins and peptides include isolated and/or purified amino acid sequences, subsequences, homologues, variants and derivatives thereof. Proteins and peptides also include those immobilized on a substrate, as well as amino acid sequences, subsequences, portions, homologues, variants, and derivatives immobilized on a substrate. Such amino acid sequences, subsequences, homologues, and variants can have a unique or distinct position or address on the substrate. Non-limiting substrates include glass, silica, plastic, polyethylene, polystyrene, polypropylene, polyacetate, polycarbonate, polyimide, polyester, polyurethane, or polyvinylchloride.

Proteins and peptides can be included in compositions, for example, a pharmaceutical composition. In particular embodiments, a pharmaceutical composition is suitable for specific or non-specific immunotherapy, or is a vaccine composition.

Isolated nucleic acid (including isolated nucleic acid) encoding a protein or peptide (Cockroach protein or peptide), or a subsequence, portion, homologue, variant or derivative thereof are provided. Such embodiments include any protein or peptide set forth herein. In one embodiment, a nucleic acid encodes an amino acid sequence of a protein or peptide set forth in any of Tables 5-8, or a subsequence, portion, homologue, variant or derivative thereof.

Also provided are cells expressing a protein or peptide described herein. In various embodiments, a cell expresses a Cockroach protein that includes, consists of or consists essentially of an amino acid sequence of a protein or peptide set forth in any of Tables 5-8, or a subsequence, portion, homologue, variant or derivative thereof, or a protein or peptide set forth in Tables 5 or 6. Non-limiting examples of cells include eukaryotic cells, prokaryotic cells, mammalian, insect, fungal (yeast) and bacterium.

Methods and uses and medicaments of Cockroach proteins and peptides of the invention are included. In various embodiments, there are provided methods and uses of and medicaments for modulating an immune response against a Cockroach allergen in a subject. In one embodiment, a method or use includes administering (delivering or contacting) to a subject an amount of a protein described herein (e.g., a protein or peptide set forth in any of Tables 5-8, or a subsequence, portion, homologue, variant or derivative thereof, or a protein or peptide set forth in Tables 5 or 6, or a subsequence, portion, homologue, variant or derivative thereof) sufficient to modulate the immune response against the allergen in the subject. In further embodiments, there are provided uses of Cockroach proteins and peptides for manufacture of a medicament to modulate the immune activity of a cell against a Cockroach allergen.

Such methods, uses and medicaments also include for example and without limitation, modulating immune activity of a cell against an allergen; and desensitizing, inducing, eliciting, increasing or improving in the cell immunological tolerance to an allergen. In particular embodiments, a method or use includes contacting a cell with an amount of the protein or peptide of any one of the embodiments disclosed herein (e.g., a protein or peptide set forth in any of Tables 5-8) or a subsequence, portion, homologue, variant or derivative thereof, or a protein or peptide set forth in Tables 5 or 6, or a subsequence, portion, homologue, variant or derivative thereof), sufficient to modulate the immune activity of the cell against the allergen (e.g., against an allergen from which the peptide or protein derives), or administering to a subject an allergen from which the peptide or protein derives in order to desensitize, induce, elicit, increase or improve immunological tolerance to the allergen or to modulate an immune response against an allergen in a subject (e.g., an allergen from which the peptide or protein derives, e.g., a protein or peptide set forth in any of Tables 5-8) or a subsequence, portion, homologue, variant or derivative thereof, or a protein or peptide set forth in Tables 5 or 6, or a subsequence, portion, homologue, variant or derivative thereof).

Invention proteins, peptides, subsequences, portions, homologues, variants and derivatives thereof are suitable as a reagent for example, for specific immunotherapy (SIT). In particular embodiments, a protein or peptide suitable as a reagent includes, consists of or consists essentially of an amino acid sequence of a protein or peptide set forth in any of Tables 5-8, or a subsequence, portion, homologue, variant or derivative thereof, or a protein or peptide set forth in Tables 5 or 6, or a subsequence, portion, homologue, variant or derivative thereof.

Such methods, uses and medicaments further include reducing risk or providing a subject protection against an allergic reaction, allergic response, allergic disorder or allergic disease. In one embodiment, a method or use includes administering to the subject an amount of the Cockroach protein or peptide (e.g., a protein or peptide set forth in any of Tables 5-8) or a subsequence, portion, homologue, variant or derivative thereof, or a protein or peptide set forth in Tables 5 or 6, or a subsequence, portion, homologue, variant or derivative thereof) sufficient to reduce risk or provide the subject with protection against the allergic reaction, allergic response, allergic disorder or allergic disease (e.g., caused by or associated with a Cockroach allergen).

Such methods, uses and medicaments additionally include treating an allergic reaction, allergic response, allergic disorder or allergic disease. In one embodiment, a method or use includes administering to the subject an amount of the Cockroach protein or peptide (e.g., a protein or peptide set forth in any of Tables 5-8) or a subsequence, portion, homologue, variant or derivative thereof, or a protein or peptide set forth in Tables 5 or 6, or a subsequence, portion, homologue, variant or derivative thereof), sufficient to treat the subject for the allergic response, allergic disorder or allergic disease (e.g., caused by or associated with a Cockroach allergen).

In such methods, uses and medicaments, a peptide or protein can be derived from or based upon the (Cockroach) allergen or can be derived from or based upon an allergen originating from the same organism as the allergen. More particularly, for example, a protein or peptide can be derived from or based upon a Cockroach allergen that contributes to or causes the allergic reaction, allergic response, allergic disorder or allergic disease or said peptide derives from an allergen belonging to the same organism as the allergen causing said allergic reaction, allergic response, allergic disorder or allergic disease. Additionally, for example, a protein or peptide can be based upon or derived from a Cockroach protein or peptide set forth in any of Tables 5-8, or a subsequence, portion, homologue, variant or derivative thereof, or a protein or peptide set forth in Table 5 or 6, or a subsequence, portion, homologue, variant or derivative thereof.

In various embodiments, a method or use or medicament desensitizes or induces, elicits, increases or improves immunological tolerance of a subject to a Cockroach allergen. In particular aspects, a method or use or medicament that desensitizes or induces, elicits, increases or improves immunological tolerance of a subject to a Cockroach allergen is a protein or peptide in any of Tables 5-8 or a subsequence, portion, homologue, variant or derivative thereof, or a protein or peptide set forth in Tables 5 or 6, or a subsequence, portion, homologue, variant or derivative thereof. In various other embodiments, a method or use or medicament desensitizes or induces, elicits, increases or improves immunological tolerance of a subject to a protein or peptide set forth in Tables 5-8, or a subsequence, portion, homologue, variant or derivative thereof, or a protein or peptide set forth in Tables 5 or 6, or a subsequence, portion, homologue, variant or derivative thereof.

In various further embodiments, a method or use or medicament reduces risk or provides the subject with protection against an allergic reaction, allergic response, allergic disorder or allergic disease (e.g., caused by or associated with a Cockroach allergen), wherein the method or use or medicament includes a protein or peptide set forth in any of Tables 5-8, or a subsequence, portion, homologue, variant or derivative thereof, or a protein or peptide set forth in Tables 5 or -6, or a subsequence, portion, homologue, variant or derivative thereof.

In various additional embodiments, a method or use or medicament treats an allergic reaction, allergic response, allergic disorder or allergic disease (e.g., caused by or associated with a Cockroach allergen), comprising wherein the method or use or medicament includes a protein or peptide set forth in any of Tables 5-8 or a subsequence, portion, homologue, variant or derivative thereof, or a protein or peptide set forth in Tables 5 or 6, or a subsequence, portion, homologue, variant or derivative thereof.

Allergic reactions, allergic responses, allergic disorders and allergic diseases as set forth herein include those caused by or associated with Cockroach exposure, contact with a Cockroach allergen or contact with an allergen homologous to a Cockroach allergen.

As set forth herein a Cockroach protein, peptide, method, use or medicament can include administration or delivery by any means to a subject, systemically, regionally or locally. In particular aspects, a protein or peptide is administered cutaneously, subcutaneously, epicutaneously, intracutaneously, intramuscularly, intravenously, orally, mucosally, by inhalation or nasally. As also set forth herein a Cockroach protein, peptide, method, use or medicament can include repeatedly contacting a cell with, or administrations to a subject, the protein or peptide, multiple times (e.g., a protein or peptide set forth in any of Tables 5-8) or a subsequence, portion, homologue, variant or derivative thereof, or a protein or peptide set forth in Tables 5 or 6, or a subsequence, portion, homologue, variant or derivative thereof).

As set forth herein, subjects in accordance with the invention include mammals, such as humans. In particular embodiments, a subject has exhibited a symptom of, or suffers from, an allergic reaction, allergic response, allergic disorder or allergic disease (e.g., caused by or associated with a Cockroach allergen). In more particular embodiments, a subject has had an allergic reaction or allergic response to a Cockroach allergen. In further particular embodiments, a subject has, has previously had or is at risk of having asthma or hypersensitivity to a Cockroach allergen. In additional particular embodiments, a subject has had an allergic reaction or allergic response to an allergen derived from or produced by Cockroach, such as an allergen or an amino acid sequence set forth in Tables 5-8, or a subsequence, portion, homologue, variant or derivative thereof, or a protein or peptide set forth in Tables 5 or 6, or a subsequence, portion, homologue, variant or derivative thereof. In still additional particular embodiments, a subject has had an allergic reaction or allergic response to a Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16 protein In still further particular embodiments, the Cockroach allergen is an IgG or IgE reactive antigen or allergen.

Proteins and peptides can be deployed in diagnostic and detection methods and uses. In one embodiment, detecting an allergic response, or diagnosing an allergy in a subject, a method or use includes contacting a cell from the subject (which may be an ex vivo or in vivo cell) with a protein or peptide as set forth herein; and determining if the protein or peptide modulates an immune response or activity from the contacted cell. If the protein or peptide modulates an immune response or activity from the contacted cell (which may be an in vitro, ex vivo or in vivo cell) detects an allergic response or indicates that the subject has an allergic response or an allergy. In a particular aspect, the allergic response or allergy comprises a Cockroach allergic response or allergy. In another particular aspect, modulation of immune response or activity is determined by assaying for a hypersensitive reaction or response, such as a cutaneous (e.g., skin) immunological hypersensitive reaction.

Proteins and peptides can be deployed in kits and uses. In one embodiment, a kit includes a compartment and instructions, which compartment includes: one or more amino acid sequences of an allergen (e.g., Cockroach) or a protein or peptide set forth in any of Tables 5-8, or a subsequence, portion, homologue, variant or derivative thereof, or a protein or peptide set forth in Tables 5 or 6, or a subsequence, portion, homologue, variant or derivative thereof; and instructions for use in any of: modulating an immune response or activity of a cell against an allergen; modulating an immune response against an allergen in a subject; desensitizing, or inducing, eliciting, increasing or improving immunological tolerance to a protein or peptide allergen; reducing risk or providing a subject protection against an allergic reaction, allergic response, allergic disorder or allergic disease; treating an allergic reaction, allergic response, allergic disorder or allergic disease; or detecting an allergic response or diagnosing an allergy in a subject.

DESCRIPTION OF DRAWINGS

FIGS. 6A-6C show Differential Immunodominance of Bla g Antigens as a Function of Allergic Clinical Status.

Figure 1A:
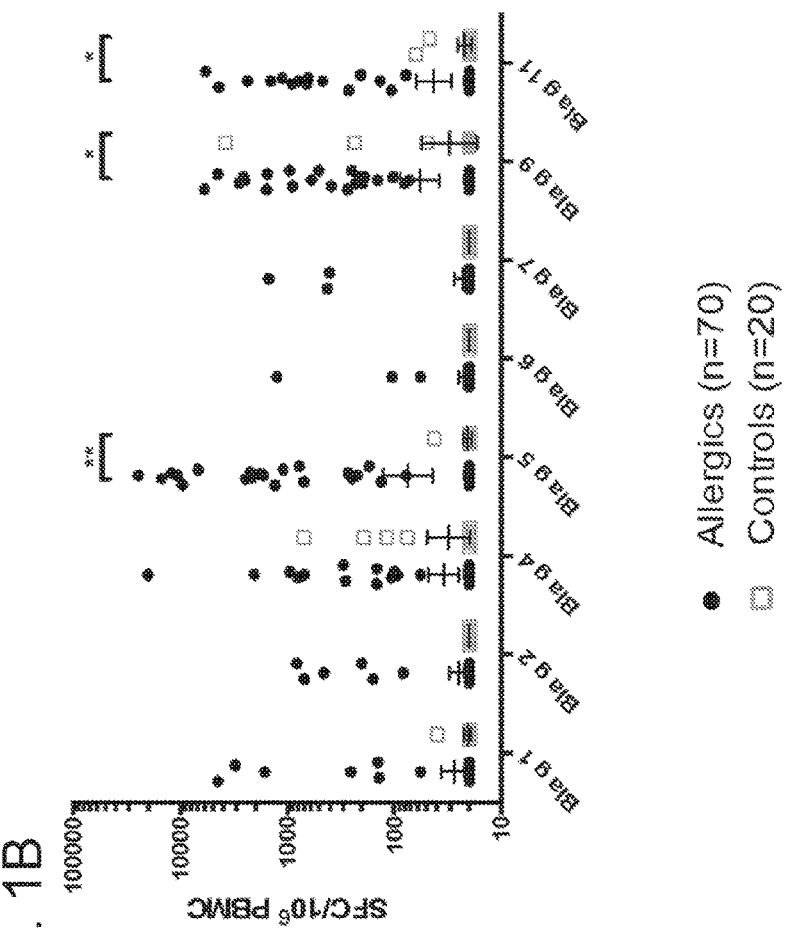
FIGS. 1A-1C show CD4$^+$ T Cell Reactivity to Bla g Allergens. A) Overall responses (sum of all peptide and cytokine responses) to BLAGA after 14-day expansion with Bla g extract followed by 24-hour stimulation with BLAGA peptides. B) Individual BLAGA responses (sum of all cytokines) of Bla g sensitized and control subjects. C) Pattern of cytokine responses detected against BLAGA Geometric means and 95% confidence intervals shown. Black circles represent Bla g sensitized subjects, and gray open circles represent controls. *$p \leq 0.05$, **$p \leq 0.005$ by non-parametric Mann-Whitney t-test.

Percentage response accounted by individual antigens of total cytokine response to all Bla g Antigens for (A) Control, (B) Allergic Rhinitis, and (C) Asthmatic Allergic subjects. "Other" category encompasses antigens accounting individually for <1% of total response for all three groups.

FIGS. 7A-7D show Epitope Sets Correctly Predict Bla g Sensitivity and Asthma. Response to specific epitope set as a percentage of total response for (A) Asthmatic and (B) AR after overnight stimulation with epitope pools following two week culture in the presence of epitope pools with corresponding magnitudes (C-D).

DETAILED DESCRIPTION

In accordance with the invention, there are provided novel Cockroach proteins and peptides, and subsequences, portions, homologues, variants and derivatives thereof. A Cockroach protein or peptide as described herein may include any Cockroach protein or peptide, or a subsequence, portion, homologue, variant or derivative thereof. In certain embodiments, a Cockroach protein or peptide as described herein may include a novel Cockroach protein or peptide, for example, as set forth in any of Tables 5-8, or a subsequence, portion, homologue, variant or derivative thereof.

In particular embodiments, a Cockroach protein or peptide described herein includes, consists or consists essentially of a protein or peptide having an amino acid sequence set out in or a protein or peptide set forth in any of Tables 5 or 6 or a subsequence, portion, homologue, variant or derivative thereof, or a protein or peptide set forth in Table 6, or a subsequence, portion, homologue, variant or derivative thereof.

In particular embodiments, a Cockroach protein described herein includes, consists or consists essentially of an amino acid sequence set out in Table 7 or a subsequence, portion, homologue, variant or derivative thereof.

In particular embodiments, a Cockroach protein or peptide described herein includes, consists or consists essentially of a protein or peptide having an amino acid sequence set forth as (SEQ ID NOs.: 1-23): TIPYYTKKFDEVVKA (SEQ ID NO: 1), ISDFRAAIANYHYDA (SEQ ID NO: 2), YFVAILDYLNHMAKE (SEQ ID NO: 3), VAISRYLGKQFGLSG (SEQ ID NO: 4), MIVDTISDFRAAIAN (SEQ ID NO: 5), DLVANQPNLKALREK (SEQ ID NO: 6), HDDRLGFLTFCPTNL (SEQ ID NO: 7), KNRTTIRGRTKFEGN (SEQ ID NO: 8), DRKMYWQFKMDKIQI (SEQ ID NO: 9), ALREKVLGLPAIKAW (SEQ ID NO: 10), IRGRTKFEGNKFTID (SEQ ID NO: 11), NDIEKRVPFSHDDRL (SEQ ID NO: 12), HMAKEDLVANQPNLK (SEQ ID NO: 13), VLEKLEAGFAKLAAS (SEQ ID NO: 14), NYAIVEGCPAAANGH (SEQ ID NO: 15), GIRIYVDVVLNQMSG (SEQ ID NO: 16), RWRQIFNMVGFRNAV (SEQ ID NO: 17), NIACLLHNKYDSTKS (SEQ ID NO: 18), NGGYLAAGKLTWADF (SEQ ID NO: 19), LNIFTNNLGRINTHV (SEQ ID NO: 20), KTPVLEIDGKQTHQS (SEQ ID NO: 21), PAYFKMNSPSLWKYN (SEQ ID NO: 22), or PKSMLLNIFTNNLGR (SEQ ID NO: 23), or a subsequence, portion, homologue, variant or derivative thereof.

In other embodiments of the invention, a Cockroach protein or peptide described herein includes, consists or consists essentially of an amino acid sequence set forth as (SEQ ID NOs.: 1-23): TIPYYTKKFDEVVKA (SEQ ID NO: 1), ISDFRAAIANYHYDA (SEQ ID NO: 2), YFVAILDYLNHMAKE (SEQ ID NO: 3), VAISRYLGKQFGLSG (SEQ ID NO: 4), MIVDTISDFRAAIAN (SEQ ID NO: 5), DLVANQPNLKALREK (SEQ ID NO: 6), HDDRLGFLTFCPTNL (SEQ ID NO: 7), KNRTTIRGRTKFEGN (SEQ ID NO: 8), DRKMYWQFKMDKIQI (SEQ ID NO: 9), ALREKVLGLPAIKAW (SEQ ID NO: 10), IRGRTKFEGNKFTID (SEQ ID NO: 11), NDIEKRVPFSHDDRL (SEQ ID NO: 12), HMAKEDLVANQPNLK (SEQ ID NO: 13), VLEKLEAGFAKLAAS (SEQ ID NO: 14), NYAIVEGCPAAANGH (SEQ ID NO: 15), GIRIYVDVVLNQMSG (SEQ ID NO: 16), RWRQIFNMVGFRNAV (SEQ ID NO: 17), NIACLLHNKYDSTKS (SEQ ID NO: 18), NGGYLAAGKLTWADF (SEQ ID NO: 19), LNIFTNNLGRINTHV (SEQ ID NO: 20), KTPVLEIDGKQTHQS (SEQ ID NO: 21), PAYFKMNSPSLWKYN (SEQ ID NO: 22), or PKSMLLNIFTNNLGR (SEQ ID NO: 23).

In other embodiments, a Cockroach protein or peptide described herein includes, consists or consists essentially of a subsequence, portion, homologue, variant or derivative of an amino acid sequence set forth as (SEQ ID NOs.: 1-23): TIPYYTKKFDEVVKA (SEQ ID NO: 1), ISDFRAAIANYHYDA (SEQ ID NO: 2), YFVAILDYLNHMAKE (SEQ ID NO: 3), VAISRYLGKQFGLSG (SEQ ID NO: 4), MIVDTISDFRAAIAN (SEQ ID NO: 5), DLVANQPNLKALREK (SEQ ID NO: 6), HDDRLGFLTFCPTNL (SEQ ID NO: 7), KNRTTIRGRTKFEGN (SEQ ID NO: 8), DRKMYWQFKMDKIQI (SEQ ID NO: 9), ALREKVLGLPAIKAW (SEQ ID NO: 10), IRGRTKFEGNKFTID (SEQ ID NO: 11), NDIEKRVPFSHDDRL (SEQ ID NO: 12), HMAKEDLVANQPNLK (SEQ ID NO: 13), VLEKLEAGFAKLAAS (SEQ ID NO: 14), NYAIVEGCPAAANGH (SEQ ID NO: 15), GIRIYVDVVLNQMSG (SEQ ID NO: 16), RWRQIFNMVGFRNAV (SEQ ID NO: 17), NIACLLHNKYDSTKS (SEQ ID NO: 18), NGGYLAAGKLTWADF (SEQ ID NO: 19), LNIFTNNLGRINTHV (SEQ ID NO: 20), KTPVLEIDGKQTHQS (SEQ ID NO: 21), PAYFKMNSPSLWKYN (SEQ ID NO: 22), or PKSMLLNIFTNNLGR (SEQ ID NO: 23).

In further embodiments, a Cockroach protein or peptide described herein includes, consists or consists essentially of a Cockroach enolase, Hsp60, RACK1, TP1, trypsin, vitellogenin or aNBGA protein (such as NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16), e.g. a Cockroach allergen/antigen set forth in Table 5.

In certain embodiments, a Cockroach protein, peptide, subsequence, portion, homologue, variant or derivative thereof, includes, consists of or consists essentially of an amino acid sequence of a portion of a Cockroach allergen protein or peptide enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11.

The foregoing and other Cockroach proteins and peptides set forth herein may be used in the methods and uses and medicaments, including but not limited to methods and uses and medicaments disclosed herein.

In particular embodiments, a protein or peptide includes, consists of or consists essentially of a Cockroach protein or peptide set forth in any of Tables 5-8, or a subsequence, portion, homologue, variant or derivative thereof, or a protein or peptide set forth in Tables 5 or 6, or a subsequence, portion, homologue, variant or derivative thereof. Said homologues may have at least 65%, 70, 75, 80, 85, 90 or 95% homology or identity to the corresponding Cockroach protein or peptide. Such subsequences may be 7 to 30 amino acids in length, and optionally further where at least 7 amino acids has at least 75%, or at least 80%, 85%, 90% identity or homology to at least 7 contiguous amino acids of the corresponding Cockroach protein or peptide. Moreover, a subsequence may be 7 to 25 amino acids in length, such as 7 to 20; 8 to 30; 8 to 25; 8 to 20; 9 to 30; 9 to 25; 9 to 20; 10 to 30; 10 to 25; 10 to 30 amino acids in length and wherein at least 8, such as at least 9, 10, 11, 12, 13, 14 or 15 amino acids of the subsequence has at least 75%, such as at least 80%, 85%, 90% identity or homology to at least 8, such as at least 9, 10, 11, 12, 13, 14 or 15 amino acids, respectively, contiguous amino acids of said corresponding Cockroach protein or peptide.

A variant of a Cockroach protein or peptide, such as a protein or peptide set forth in any of Tables 5-8 may be a longer peptide, for example, of up to 30 amino acids in length and which includes a corresponding protein or peptide as set forth in any of Tables 5-8. A variant may also include a peptide of 7 to 30 amino acids in length and which includes a subsequence of at least 7 amino acids having at least 75% identity or homology, such as at least 80 or 85% identity or homology, to at least 7 contiguous amino acids of the corresponding amino acid sequence of a protein or peptides set forth in any of Tables 5-8. A longer variant peptide may be up to 25 amino acids in length, such as up to 24, 23, 22, 21, 20, 19 or 18 amino acids in length. The variant may be a peptide of 7 to 25 amino acids in length, such as 7 to 20; 8 to 30; 8 to 25; 8 to 20; 9 to 30; 9 to 25; 9 to 20; 10 to 30; 10 to 25; 10 to 30 amino acids in length and wherein said subsequence is of at least 8, 9 or 10 amino acids having at least 75% (such as at least 80% or 85%) identity or homology to at least 8, 9 or 10 contiguous amino acids, respectively, of said corresponding protein or peptide set forth in any of Tables 5-8.

As used herein, an "antigen" refers to a substance, including but not limited to a protein or peptide that elicits, induces, stimulates, promotes or enhances an immune response when administered to a subject. An immune response elicited by an antigen may include, but is not limited to, a B cell or a T cell response. An immune response can include a cellular response with a particular pattern of lymphokine/cytokine production (e.g., Th1, Th2), a humoral response (e.g., antibody production), or a combination thereof, to a particular antigen. For example, if a subject previously exposed to an allergen (i.e., is sensitized or is hypersensitive) comes into contact with the allergen again, allergic asthma may develop due to a Th2 response characterized by an increased production of type 2 cytokines (e.g., IL-4, IL-5, IL-9, and/or IL-13) secreted by CD4+T lymphocytes.

As used herein an "epitope" refers to a region or part of an antigen that elicits an immune response when administered to a subject. In particular embodiments, an epitope may be comprised of a region or part of a Cockroach protein or peptide (e.g, of all or a part of an amino acid sequence of a Cockroach protein or peptide set forth in any of Tables 5-8. In more particular embodiments, an epitope may be comprised of a region or part of a Cockroach protein or peptide set forth in any of Table 5 or 6, or a protein or peptide set forth in Table 5. In particular aspects, an epitope is a T cell epitope, i.e., an epitope that elicits, stimulates, induces, promotes, increases or enhances a T cell activity, function or response.

An antigen, epitope, allergen, or composition thereof can modulate an undesired or abnormal inflammatory response. An antigen, epitope, allergen, or composition thereof as described herein may alter the Th2 response by, for example, shifting the immune response toward a Th1 phenotype that is less damaging. That is, an altered (or modulated) immune response can decrease, inhibit, suppress, or reduce sensitivity (desensitize) to an antigen, epitope, or allergen, or against inflammatory responses (e.g., allergy, asthma, rash, wheezing, coughing, eye irritation, etc.) caused by an antigen, epitope, or allergen (e.g., a Cockroach protein or peptide set forth in any of Tables 5-8), or a protein or peptide set forth in Tables 5 or 6 or Table 5).

Accordingly, non-limiting examples of antigens and allergens are peptides and proteins having defined amino acid sequences and which comprise T cell epitopes, i.e., elicit, stimulate, induce, promote, increase or enhance a T cell response or activity. Antigens and allergens can be analyzed to determine whether they include at least one T cell epitope using any number of assays (e.g. T cell proliferation assays, lymphokine secretion assays, T cell non-responsiveness studies, etc.).

The term "allergen" refers to an antigen which elicits, induces, stimulates, or enhances an immune response by a cell or the immune system of an exposed animal (e.g., human). An antigen is an allergen when the specific immune response is the development of enhanced sensitivity or a hypersensitivity to the antigen, but the antigen itself is not typically innately harmful. An allergen is therefore a particular type of antigen that can cause development of enhanced or increased sensitivity or hypersensitivity in a subject. For example, an allergen can elicit production of IgE antibodies in predisposed subjects. However, as disclosed herein an allergen need not elicit production of IgE antibodies. Other examples of responses elicited by allergens include T cell responses or activity, such as production of a lymphokine, cytokine, or effector function on other cells. Responses caused by allergens are also described, for example, in Mol. Biol. of Allergy and Immunology, ed. R. Bush, Immunology and Allergy Clinics of North American Series (August 1996). Although the terms "allergen" and "antigen" have a different meaning, reference to "allergen" herein includes reference to "antigen" and reference to "antigen" herein includes reference to "allergen."

Typically, allergens are organic substances, such as proteins, peptides, nucleotides, carbohydrates, lipids, fats, nucleic acid, and combinations or mixtures thereof. Allergen(s) as used herein include, but are not limited to a specific allergen protein, mixture of allergen proteins, an extract of an allergen, chemically or genetically manufactured allergen, or any combination thereof (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16) or a protein or peptide set forth in Tables 5-8, Tables 5 or 6, or Table 5. Particular examples include a Cockroach enolase, Hsp60, RACK1, TP1, trypsin, vitellogenin, or a NBGA (such as NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16).

In certain embodiments, proteins, peptides, subsequences, portions, homologues, variants and derivatives thereof, described herein (e.g., a Cockroach protein or peptide set forth in any of Tables 5-8, or a protein or peptide set forth in Tables 5 or 6 stimulate, induce, promote, increase or enhance an immune response. In particular embodiments, a protein or peptide is a T cell antigen, allergen or epitope. In additional particular embodiments, a protein or peptide, a subsequence, portion, homologue, variant or derivative thereof, elicit, stimulate, promote, induce or enhance a T cell response, which may include but is not limited to a Th2 cell response. In further particular embodiments, a Cockroach protein or peptide, a subsequence, portion, homologue, variant or derivative thereof, modulates, inhibits, or reduces T cell response, which may include but is not limited to a Th2 cell response. In certain embodiments, a T cell response is an anti-allergen immune response, including but not limited to an anti-Cockroach allergen immune response.

As used herein, the term "immune response" includes T cell (cellular) mediated and/or B cell (humoral) mediated immune responses, or both cellular and humoral responses. Exemplary immune responses include T cell responses, e.g., lymphokine production, cytokine production and cellular cytotoxicity. T-cell responses include Th1 and/or Th2 responses. In addition, the term immune response includes responses that are indirectly effected by T cell activation, e.g., antibody production (humoral responses) and activation of cytokine responsive cells, e.g., eosinophils, macrophages. Immune cells involved in the immune response include lymphocytes, such as T cells (CD4+, CD8+, Th1 and Th2 cells, memory T cells) and B cells; antigen presenting cells (e.g., professional antigen presenting cells such as dendritic cells, macrophages, B lymphocytes, Langerhans cells, and non-professional antigen presenting cells such as keratinocytes, endothelial cells, astrocytes, fibroblasts, oligodendrocytes); natural killer (NK) cells; myeloid cells, such as macrophages, eosinophils, mast cells, basophils, and granulocytes.

As set forth herein, a particular immunoglobulin (Ig) isotype may be produced in response to an antigen (allergen). For example, an "IgG antigen" refers to an antigen that induces an IgG antibody response. Likewise, an "IgE antigen" refers to an antigen that induces an IgE antibody response; an "IgA antigen" refers to an antigen that induces an IgA antibody response, and so forth. In certain embodiments, such an immunoglobulin (Ig) isotype produced in response to an antigen may also elicit production of other isotypes. For example, an IgG antigen may induce an IgG antibody response in combination with one more of an IgE, IgA, IgM or IgD antibody response. Accordingly, in certain embodiments, an IgG antigen may induce an IgG antibody response without inducing an IgE, IgA, IgM or IgD antibody response.

The invention encompasses methods and uses and medicaments for reducing, decreasing, preventing the development of sensitization or hypersensitization to an antigen(s) or allergen(s), such as a Cockroach antigen or allergen. Accordingly, in other embodiments, a protein or peptide, subsequence, portion, homologue, variant or derivative thereof (e.g., a Cockroach protein or peptide set forth in any of Tables 5-8, or a protein or peptide set forth in Tables 5 or 6 or Table 5, decreases, inhibits, suppresses or reduces a T cell response, which may include but is not limited to a Th2 cell response. In certain embodiments, the T cell response is an anti-Cockroach allergen immune response, such as a memory T cell response.

In accordance with another aspect of the invention there are provided a Cockroach protein or peptide, a subsequence, portion, homologue, variant or derivative thereof, wherein the protein or peptide elicits, stimulates, induces, promotes, increases or enhances an anti-allergen immune response. In another aspect, there are provided a Cockroach protein or peptide, subsequence, portion, homologue, variant or derivative thereof, wherein the protein or peptide decreases, reduces, inhibits, suppresses or disrupts an anti-allergen immune response.

As will be understood by a person of skill in the art, a protein or a subsequence, portion, homologue, variant or derivative thereof as described herein (e.g., Cockroach protein or peptide set forth in any of Tables 5-8) may elicit, stimulate, induce, promote, increase or enhance certain elements of an anti-allergen immune response while decreasing, reducing, inhibiting, suppressing or reducing other elements of the anti-allergen response, either contemporaneously or sequentially. In one non-limiting example, a protein or a subsequence, portion, homologue, variant or derivative thereof (e.g., Cockroach protein or peptide set forth in any of Tables 5-8) may elicit, stimulate, induce, promote, increase or enhance proliferation of regulatory T cells while decreasing, reducing, inhibiting, suppressing or reducing production of proinflammatory lymphokines/cytokines.

An "anti-allergen," "anti-protein," or "anti-peptide immune response" refers to an immune response that is particular or specific for the protein or peptide, e.g., allergen. In such instances, the response is specifically triggered (elicited, stimulated, increased, induced, or promoted) by the protein or peptide, e.g., allergen (e.g., a Cockroach protein or peptide set forth in any of Tables 5-8). Although an "anti-allergen" immune response is specifically triggered by a given allergen, the immune response itself can be characterized by general features of immune responses, such as T cell (cellular) and/or B cell (humoral) immune responses, as set forth herein.

As disclosed herein, a Cockroach protein, peptide, subsequence, portion, homologue, variant or derivative thereof, may elicit, stimulate, induce, promote, increase or enhance immunological tolerance to an antigen, including an allergen (e.g., Cockroach protein or peptide set forth in any of Tables 5-8). In certain embodiments, a Cockroach protein, peptide, subsequence, portion, homologue, variant or derivative thereof, described herein may elicit, stimulate, induce, promote, increase or enhance immunological tolerance to an allergen. Thus in certain embodiments a protein, peptide, subsequence, portion, homologue, variant or derivative thereof, described herein may be effective in use or treatment (e.g., therapeutic) of an allergic reaction or allergic immune response, including but not limited to an allergic response following a secondary or subsequent exposure of a subject to an antigen or allergen. In particular embodiments, immunological tolerance elicited, stimulated, induced, promoted, increased or enhanced from use or administration of a Cockroach protein, peptide, subsequence, portion, homologue, variant or derivative thereof, may involve modulation of T cell activity, including but not limited to CD4+ T cells, CD8+ T cells, Th1 cells, Th2 cells and regulatory T cells (Tregs), and memory T cells. For example, immunological tolerance elicited, stimulated, induced, promoted, increased or enhanced from use or administration of a Cockroach protein, peptide, subsequence, portion, homologue, variant or derivative thereof (e.g., Cockroach protein or peptide set forth in any of Tables 5-8)-inflammatory lymphokines/cytokines produced by T cells. Thus, in accordance with certain aspects of the invention, there are provided Cockroach proteins, peptides, subsequences, portions, homologues, variants and derivatives thereof, that elicit, stimulate, induce, promote, increase or enhance immunological tolerance to an antigen or allergen (e.g., a Cockroach protein or peptide).

Accordingly, methods and uses and medicaments of inducing immunological tolerance in a subject to an allergen are provided. In one embodiment, a method or use reduces occurrence, frequency, severity, progression, or duration of physiological conditions, disorders, illnesses, diseases, symptoms or complications caused by or associated an allergic response to the allergen in the subject. Thus, in various embodiments, inducing immunological tolerance can protect a subject against or treat a subject for an allergic response, allergic disorder or allergic disease, or one or more physiological conditions, disorders, illnesses, diseases, symptoms or complications caused by or associated with an allergen.

As disclosed herein, surprisingly Cockroach proteins and antigens that elicit Th2 immune responses are not a priori IgE reactive. Thus, there are provided methods and uses of providing specific immunotherapy to a subject, in which a subject is administered an amount of a Cockroach protein or peptide that is (or is not) an IgE, IgG, IgA, IgM or IgD reactive antigen. In a particular embodiment, a method or use includes administering to the subject an amount of a Cockroach protein or peptide that is not an IgE reactive antigen.

Also provided are methods and uses and medicaments of providing specific immunotherapy (SIT) to a subject. In one embodiment, a subject is administered an amount of a Cockroach protein or peptide (e.g., Cockroach protein or peptide set forth in any of Tables 5-8).

In certain embodiments of the invention methods and uses and medicaments, the allergen is a Cockroach protein or peptide (e.g., a Cockroach allergen such as Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16). In more particular embodiments, the allergen is an amino acid sequence of Cockroach protein or peptide set forth in any of Tables 5-8, or a subsequence, portion, homologue, variant or derivative thereof. In other non-limiting embodiments, the allergen includes, consists of or consists essentially of a Cockroach protein or peptide set forth in any of Tables 5-8.

An allergic reaction refers to a local or general reaction in a subject following contact with a specific antigen (e.g., allergen) to which the subject had been previously exposed and had become sensitized. The immunologic interaction of antigen (e.g., allergen) with sensitized lymphocytes (T cells) and/or antibody can give rise to inflammation and tissue damage. An allergy is an undesirable immune response or reaction that can therefore produce damage to self-tissues and cells, usually through inflammatory reactions.

One non-limiting example of an allergy is asthma. Asthma, which can be extrinsic or allergic asthma (also referred to as reactive airway disease), is an inflammatory disease of the lungs characterized by a generally reversible airway obstruction. Non-limiting features of allergic asthma include elevated concentrations of serum IgE, pulmonary eosinophilia, airway hyper-responsiveness, excessive airway mucus production, and airway remodeling marked by peribronchiolar collagen deposition and increases in airway smooth muscle mass. Other exemplary allergic reactions or inflammatory conditions include allergic alveolitis, allergic bronchopulmonary aspergillosis, allergic dermatitis, eczema, allergic conjunctivitis, allergic coryza, allergic vasculitis, rhinosinusitis, and allergic rhinitis.

Hypersensitivity or hyper-responsiveness used in reference to an immune response means an abnormal response or condition in which an antigen or allergen elicits an exaggerated immune response. For example, allergic asthma can result from repeated exposure to airborne allergens that trigger detrimental immunological responses, such as persistent inflammation in the bronchial wall, which can in turn cause structural and functional changes in the respiratory system. After allergen contact by sensitized subjects (i.e., those subjects that have already been exposed to the allergen), the immune response is dependent on CD4+T lymphocytes that are skewed to a T helper (Th) 2 phenotype. Th2 cytokines, for example, IL-4, IL-5, IL-9, and IL-13 are produced and are believed to contribute to asthma pathogenesis. For example, IL-4 drives the T helper response in favor of Th2, resulting in enhanced production of IgE; IL-5, which with granulocyte macrophage colony stimulating factor (GM-CSF) and IL-3, is important for the production of eosinophils; and IL-13, which is required for airway hyper-responsiveness and mucous metaplasia, which are downstream pathophysiological features that are closely linked with clinical asthma. All of these cytokines have been implicated in airway remodeling. Increased numbers of airway eosinophils is also associated with disease severity, although the role of eosinophils in the pathology of asthma is not entirely understood, (see, e.g., Lee et al., *Science* 305:1773 (2004); Humbles et al., *Science* 305:1776 (2004)). The resulting structural and morphometric changes (remodeling) include subepithelial fibrosis, goblet cell hyperplasia and metaplasia, which result in functional consequences such as loss of distensibility of asthmatic airways, bronchial hyper-reactivity (even in the absence of the allergen), and an accelerated progressive decrease in forced expiratory volume at 1 second time intervals. Th2 cytokines may also prime and activate eosinophils to release proinflammatory agents, lipid mediators, and other cytokines thought to contribute to the observed tissue damage, remodeling, and hyper-responsiveness.

As used herein, the term "tolerance," "anergy," or "antigen (allergen)-specific tolerance" refers to a reduction, loss, inhibition, suppression or decrease, of T cells to T cell receptor-mediated stimulation by an allergen or antigen (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8). The reduction can lead to reduced or non-responsiveness (insensitivity) of T cells to an allergen or antigen. Such insensitivity is generally antigen-specific and persists after exposure to the antigenic peptide has ceased. For example, tolerance in T cells is characterized by lack of lymphokine/cytokine production, e.g., IL-2, IFN-γ, or TNF-β. T-cell anergy occurs when T cells are exposed to antigen or allergen and receive a first signal (a T cell receptor or CD-3 mediated signal) in the absence of a second signal (a costimulatory signal). Under these conditions, re-exposure of the cells to the same antigen or allergen (even if re-exposure occurs in the presence of a costimulatory molecule) results in failure to produce cytokines and subsequently failure of T cells to proliferate. Thus, a failure to produce lymphokines/cytokines prevents proliferation. Tolerized T cells can, however, proliferate if cultured with cytokines (e.g., IL-2). For example, T cell anergy can also be observed by the lack of IL-2 production by T lymphocytes as measured by ELISA or by a proliferation assay using an indicator cell line.

As used herein, the term "immunological tolerance" refers to a) a decreased or reduced level of a specific immunological response (thought to be mediated at least in part by antigen-specific effector T lymphocytes, B lymphocytes, antibody or a combination); b) a delay in the onset or progression of a specific immunological response; or c) a reduced risk of the onset or progression of a specific immunological response to an antigen or allergen (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16 or a Cockroach protein or peptide set forth in any of Tables 5-8). "Specific" immunological tolerance occurs when tolerance is preferentially invoked against certain antigens (allergens) in comparison with other antigens (allergens). Tolerance is an active antigen dependent process and differs from non-specific immunosuppression and immunodeficiency.

An increase, improvement, enhancement or induction of "tolerance" refers to a decrease, reduction, inhibition, suppression, or limiting or controlling or clearing of specific immunological reactivity to an antigen (allergen) as compared to reactivity to the antigen in a previous exposure to the same antigen. Thus in certain embodiments, a method or use of inducing immunological tolerance in a subject to an allergen includes elimination of an allergic response of the subject to the allergen (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8). Immunological tolerance in a subject to an allergen can also be reflected by reducing the occurrence, frequency, severity, progression, or duration of an allergic response of the subject to the antigen or allergen (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8).

While desirably tolerance can refer to non-reactivity to an antigen or allergen, tolerance need not be complete non-reactivity and can only be partial, and in any event is reflected by a decrease, inhibition, suppression or reduction in specific immunological reactivity to an antigen or allergen as compared to reactivity to the antigen or allergen in a previous exposure to the same antigen or allergen (or epitope thereof). Thus, in another embodiment, a method or use of inducing immunological tolerance in a subject to an allergen includes stabilizing or maintaining the level of an allergic response in the subject to the allergen (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8).

Induction of immune tolerance (also referred to as desensitization), and the relative amount of immune tolerance, can be measured by methods disclosed herein or known to the skilled artisan. For example, induction of immune tolerance can be measured by modulation of lymphokine and/or cytokine level in said animal. As such, modulation can be an increase of a cytokine level, for instance an increase of a cytokine level at least 1.5, 2, 3 times or more relative to before said induction. Alternatively, modulation can be a decrease of the level of a particular cytokine level, for instance a decrease of the cytokine level is at least 1.5, 2, 3 times or more relative to before said induction. The lymphokines/cytokines chosen to measure can be from any relevant lymphokines/cytokines, such as IL-2, IL-5, IL-4, IL-6, IL-10, IL-12, IL-13, TNF-α, IFN-γ, TGF-β, MCP-1, RANK-L and Flt-3L.

As disclosed herein, peptides and proteins of the invention are useful in methods and uses and medicaments, for example, of "specific" immunotherapy (SIT). The term "specific" immunotherapy refers to a therapy particular or specific for the protein or peptide, e.g., allergen (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8). To achieve "specific immunotherapy" an antigen is administered to a subject in order to achieve immunological tolerance of the subject to an antigen, including for example, an allergen (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8).

More particularly, specific immunotherapy may be conducted by administering an antigen derived from the antigen (e.g. allergen) against which immunological tolerance is sought. Alternatively, immunotherapy can be conducted by "non-specific" immunotherapy using a different antigen or protein than the antigen (allergen) against which immunological tolerance is sought. For example as described in US patent application publication US2012/0100164A1, which relates to the treatment of a hypersensitivity immune response, such as allergic rhinitis or asthma, via bystander suppression by use of an antigen unrelated to the allergen triggering the hypersensitivity immune response in an individual to be treated provided that the antigen is obtainable from the source material, e.g. a Cockroach antigen for treatment of an immune response to another Cockroach allergen (e.g. a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16).

Thus, in different embodiments, the Cockroach antigen administered and antigen (e.g. allergen) against which immunological tolerance is sought may be the same or a different Cockroach protein. In one embodiment, a method or use includes administering to a subject an amount of a Cockroach protein or peptide, or subsequence, portion, homologue, variant or derivative thereof sufficient to elicit, stimulate, induce, promote, increase, enhance or augment immunological tolerance to an allergen (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8) in the subject. In one aspect, a Cockroach antigen is administered to a subject during specific immunotherapy to treat the subject for an allergic reaction to the same Cockroach antigen. In a different aspect, a Cockroach antigen is administered to a subject during specific immunotherapy to treat the subject for an allergic reaction to a different Cockroach antigen. In another embodiment, a method includes administering to a subject an amount of a nucleic acid encoding all or a portion (e.g., a T cell epitope) of a Cockroach protein or peptide, or subsequence, portion, homologue, variant or derivative thereof sufficient to elicit, stimulate, induce, promote, increase, enhance or augment immunological tolerance to an allergen (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16)) in the subject. In various embodiments, a method or use of specific immunotherapy reduces, inhibits, suppresses or decreases sensitivity or (hyper)sensitivity to the protein or peptide, e.g., allergen, or elicits, stimulates, increases, induces, promotes or improves tolerance of the protein or peptide, e.g., allergen. Typically a subject is administered a protein or peptide, e.g., allergen, for example, via a subcutaneous injection.

Methods and uses include multi-dose regimens. For example, a method or use can begin with small doses of allergen or protein or peptide (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8) and the doses are increased for repeated contact or administration.

A variant or derivative of an antigen (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8), including an allergen as described herein, or a subsequence or portion of an antigen or allergen, include molecules that are structurally similar and functionally similar (e.g, of all or a part of an amino acid sequence in any of Tables 5-8). A variant, derivative or subsequence of antigen or allergen is functionally similar to the antigen or allergen sequence if the variant, derivative or subsequence is capable of eliciting a detectable or measurable immune response, even if it is a reduced immune response compared to the nonvariant/non-derived or native sequence, which may be determined using methods, including animal models and in vitro assays, described herein and know to one of skill in the art. For example, an immune response may be determined by quantitative and/or qualitative determination of lymphokine/cytokine production (e.g., by T cells), antibody production (including class and/or isotype), cellular mobilization, migration or motility, and optionally in vivo, such as an animal model of antigen/ allergen immune responsiveness. An immune response of variant, derivative or subsequence of antigen or allergen compared to the non-variant/non-derivatized/native full length antigen or allergen may be ascertained by analysis of a particular measure (such as lymphokine/cytokine production, immunoglobulin production, cell mobilization, migration, motility, etc.) and may be greater, less than or comparable, e.g., within 5%, 10%, 15%, or 20% or 25% of the immune response of non-variant/non-derivatized/native full length antigen or allergen. For example, levels of Th1 lymphokines/cytokines, such as IFN-$\gamma$ IL-2, and TNF-$\beta$ and Th2 cytokines, such as IL-4, IL-5, IL-9, IL-10, and IL-13, may be determined according to methods described herein or known to one of skill in the art.

As disclosed herein, proteins and peptides, or a subsequence, portion, homologue, variant or derivative thereof include those having all or at least partial sequence identity to one or more exemplary proteins and peptides, or a subsequence, portion, homologue, variant or derivative thereof (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8). The term "identity" and "identical" and grammatical variations thereof, mean that two or more referenced entities are the same (e.g., peptides or polynucleotide molecules). Thus, where two proteins, peptides, subsequences, portions, homologues, variants or derivatives thereof are identical, they have the same amino acid sequence. The identity can be over a defined area (region or domain) of the sequence. "Areas, regions or domains" of homology or identity mean that a portion of two or more referenced entities share homology or are the same.

Identity can be determined by comparing each position in aligned sequences. A degree of identity between amino acid sequences is a function of the number of identical or matching amino acids at positions shared by the sequences, i.e. over a specified region. Optimal alignment of sequences for comparisons of identity may be conducted using a variety of algorithms, as are known in the art, including the ClustalW program, available at http://clustalw.genom-e.ad.jp, the local homology algorithm of Smith and Waterman, 1981, *Adv. Appl. Math* 2: 482, the homology alignment algorithm of Needleman and Wunsch, 1970, *J. Mol. Biol.* 48:443, the search for similarity method of Pearson and Lipman, 1988, *Proc. Natl. Acad. Sci. USA* 85: 2444, and the computerized implementations of these algorithms (such as GAP, BESTFIT, FASTA and TFASTA in the Wisconsin Genetics Software Package, Genetics Computer Group, Madison, Wis., U.S.A.). Sequence identity may also be determined using the BLAST algorithm, described in Altschul et al., 1990, *J. Mol. Biol.* 215:403-10 (using the published default settings). Software for performing BLAST analysis may be available through the National Center for Biotechnology Information (through the internet at http://www.ncbi.nlm.nih.gov/j. Such algorithms that calculate percent sequence identity (homology) generally account for sequence gaps and mismatches over the comparison region or area. For example, a BLAST (e.g., BLAST 2.0) search algorithm (see, e.g., Altschul et al., *J. Mol. Biol.* 215:403 (1990), publicly available through NCBI) has exemplary search parameters as follows: Mismatch-2; gap open 5; gap extension 2. For polypeptide sequence comparisons, a BLASTP algorithm is typically used in combination with a scoring matrix, such as PAM100, PAM 250, BLOSUM 62 or BLOSUM 50. FASTA (e.g., FASTA2 and FASTA3) and SSEARCH sequence comparison programs are also used to quantitate the extent of identity (Pearson et al., *Proc. Natl. Acad. Sci. USA* 85:2444 (1988); Pearson, *Methods Mol Biol.* 132:185 (2000); and Smith et al., J. Mol. Biol. 147:195 (1981)). Programs for quantitating protein structural similarity using Delaunay-based topological mapping have also been developed (Bostick et al., *Biochem Biophys Res Commun.* 304:320 (2003)).

As described herein, Cockroach proteins and peptides include homologues of Cockroach proteins and peptides (e.g., of all or a part of any amino acid sequence of any protein or peptide in any of Tables 5-8). A polypeptide sequence or polynucleotide sequence is a "homologue" of, or is "homologous" to, another sequence if the two sequences have substantial identity over a specified region and a functional activity of the sequences is preserved or conserved, at least in part (as used herein, the term 'homologous' does not infer nor exclude evolutionary relatedness).

Accordingly, in particular embodiments, methods and uses and medicaments of the invention include homologues of peptides and proteins from non-Cockroach allergens, including for example other antigens and allergens, such as non-Cockroach proteins and peptides considered to be homogoues as set forth herein (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8). Thus, as a non-limiting example, peptide and protein homologues from non-Cockroach antigens or allergens may be administered or used to modulate immune activity or immune response against a Cockroach allergen or antigen or to treat an allergic reaction, allergic response, allergic disorder or allergic disease associated with a Cockroach allergen or antigen. As another non-limiting example, peptide and protein homologues from non-Cockroach antigens or allergens may be administered or used to modulate immune activity or immune response against a non-Cockroach allergen or antigen or to treat an allergic reaction, allergic response, allergic disorder or allergic disease associated with a non-Cockroach allergen or antigen.

Two polypeptide sequences or polynucleotide sequences are considered to be substantially identical if, when optimally aligned (with gaps permitted), they share at least about 40% sequence identity or greater (e.g. 45%, 50%, 55%, 60%, 65%, 70%, 75%, 80%, 85%, 90%, 95%, 96%, 97%, 98%, 99%, etc. identify over a specific region), for example, over all or a part of any Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8, or if the sequences share defined functional motifs (e.g., epitopes). The percent identity can extend over the entire sequence length or a portion of the sequence (e.g., over all or a part of any amino acid sequence in any protein or peptide set forth in any of Tables 5-8. In particular aspects, the length of the sequence sharing the percent identity is 2, 3, 4, 5 or more contiguous amino acids, e.g., 6, 7, 8, 9, 10, 11, 12, 13, 14, 15, 16, 17, 18, 19, 20, etc. contiguous amino acids (e.g., over all or a part of any amino acid sequence in any protein or peptide set forth in any of Tables 5-8). In additional particular aspects, the length of the sequence sharing the percent identity is 20 or more contiguous amino acids, e.g., 21, 22, 23, 24, 25, 26, 27, 28, 29, 30, 31, 32, 33, 34, 35, etc. contiguous amino acids (e.g., over all or a part of any amino acid sequence in any Cockroach protein or peptide set forth in any of Tables 5-8). In further particular aspects, the length of the sequence sharing the percent identity is 35 or more contiguous amino acids, e.g., 36, 37, 38, 39, 40, 41, 42, 43, 44, 45, 45, 47, 48, 49, 50, etc., contiguous amino acids (e.g., over all or a part of any amino acid sequence in any Cockroach protein or peptide set forth in any of Tables 5-8). In yet further particular aspects, the length of the sequence sharing the percent identity is 50 or more contiguous amino acids, e.g., 50-55, 55-60, 60-65, 65-70, 70-75, 75-80, 80-85, 85-90, 90-95, 95-100, etc. contiguous amino acids (e.g., over all or a part of any amino acid sequence in any Cockroach protein or peptide set forth in any of Tables 5-8).

An "unrelated" or "non-homologous" sequence shares less than 30% identity. More particularly, shares less than about 25% identity, with a protein, peptide or polynucleotide of the invention over a specified region of homology.

A variant or derivative of a protein or peptide refers to a modified or variant form of the protein or peptide, or subsequence, portion or homologue thereof (e.g., over all or a part of any Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8). Such modified forms, such as amino acid deletions, additions and substitutions, of the proteins and peptides can also be used in the invention uses, methods and compositions, including methods for modulating an immune response, eliciting, stimulating, inducing, promoting, increasing, or enhancing immunological tolerance and protecting and treating subjects against an allergic reaction or response, as set forth herein.

Thus, in accordance with the invention, modified, variant and derivative forms of proteins and peptides, subsequences, portions, and homologues thereof (e.g., of a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8) are provided that have one or more functions or activities of unmodified, non-variant and non-derivatized forms of proteins and peptides. Such forms, referred to as "modifications", "variants" or "derivatives" and grammatical variations thereof deviate from a reference sequence. For example, as described herein, a protein, peptide, subsequence, portion, or homologue thereof may comprise, consist or consist essentially of an amino acid sequence that is a modification, variant, or derivative of a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8. Such modifications, variants, or derivatives may have greater or less activity or function than a reference protein or peptide, such as ability to elicit, stimulate, induce, promote, increase, enhance, activate, modulate, inhibit, decreases, suppress, or reduce an immune response (e.g. a T cell response) or elicit, stimulate, induce, promote, increase or enhance immunological tolerance (desensitize) to an antigen or allergen. Thus, proteins, peptides, or subsequences, portions or homologues thereof include sequences having substantially the same, greater or less relative activity or function as a reference antigen or allergen (e.g., any Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8) for example, an ability to elicit, stimulate, induce, promote, increase, enhance, activate, modulate, inhibit, suppress, decrease or reduce an immune response (e.g. a T cell response) or elicit, stimulate, induce, promote, increase or enhance immunological tolerance to an antigen or allergen in vitro or in vivo.

A variant or derivative therefore includes deletions, including truncations and fragments; insertions and additions, including tagged polypeptides and fusion proteins; substitutions, for example conservative substitutions, site-directed mutants and allelic variants; and modifications, including peptoids having one or more non-amino acyl groups (q.v., sugar, lipid, etc.) covalently linked to the peptide and post-translational modifications.

Non-limiting examples of modifications include one or more amino acid substitutions (e.g., 1, 2, 3, 4, 5, 6, 7, 8, 9, 10, 11, 12, 13, 14, 15, 16, 17, 18, 19, 20, 20-25, 25-30, 30-50, 50-100, or more residues), additions and insertions (e.g., 1, 2, 3, 4, 5, 6, 7, 8, 9, 10, 11, 12, 13, 14, 15, 16, 17, 18, 19, 20, 20-25, 25-30, 30-50, 50-100, or more residues) and deletions (e.g., 1, 2, 3, 4, 5, 6, 7, 8, 9, 10, 11, 12, 13, 14, 15, 16, 17, 18, 19, 20, 20-25, 25-30, 30-50, 50-100) of a reference protein, peptide, or subsequence or portion thereof (e.g., over all or a part of any amino acid sequence in any protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8). In particular embodiments, a modified or variant sequence retains at least part of a function or an activity of unmodified sequence, and can have less than, comparable, or greater, but at least a part of, a function or activity of a reference sequence, for example, the ability elicit, stimulate, induce, promote, increase, enhance, activate, modulate, inhibit, suppress, decrease, or reduce an immune response (e.g. a T cell response) or elicit, stimulate, induce, promote, increase or enhance immunological tolerance to an allergen. Such immune responses include, for example, among others, induced, increased, enhanced, stimulated, activated, modulated, inhibited, suppressed, decreased or reduced expression, production or activity of a cytokine (e.g., IL-5, etc.), an antibody (e.g. increase production of IgG antibodies, decrease production of IgE) or an immune cell (e.g. CD4+ T cell, CD8+ T cell, Th1 cell, Th2 cell or regulatory T cell).

Variants and derivatives of proteins and peptides include naturally-occurring polymorphisms or allelic variants, strain variants, as well as synthetic proteins and peptides that contain a limited number of conservative amino acid substitutions of the amino acid sequence. A variety of criteria can be used to indicate whether amino acids at a particular position in a protein or peptide are similar. In making such changes, substitutions of like amino acid residues can be made on the basis of relative similarity of side-chain substituents, for example, their size, charge, hydrophobicity, hydrophilicity, and the like, and such substitutions may be assayed for their effect on the function of the peptide by routine testing.

Specific non-limiting examples of substitutions include conservative and non-conservative amino acid substitutions. A "conservative substitution" is the replacement of one amino acid by a biologically, chemically or structurally similar residue. Biologically similar means that the substitution does not destroy a biological activity. Structurally similar means that the amino acids have side chains with similar length, such as alanine, glycine and serine, or a similar size. Chemical similarity means that the residues have the same charge, or are both hydrophilic or hydrophobic. For example, a conservative amino acid substitution is one in which an amino acid residue is replaced with an amino acid residue having a similar side chain, which include amino acids with basic side chains (e.g., lysine, arginine, histidine); acidic side chains (e.g., aspartic acid, glutamic acid); uncharged polar side chains (e.g., glycine, asparagine, glutamine, serine, threonine, tyrosine, cysteine, histidine); nonpolar side chains (e.g., alanine, valine, leucine, isoleucine, proline, phenylalanine, methionine, tryptophan); beta-branched side chains (e.g., threonine, valine, isoleucine), and aromatic side chains (e.g., tyrosine, phenylalanine, tryptophan). Particular examples include the substitution of one hydrophobic residue, such as isoleucine, valine, leucine or methionine for another, or the substitution of one polar residue for another, such as the substitution of arginine for lysine, glutamic for aspartic acids, or glutamine for asparagine, serine for threonine, and the like. Proline, which is considered more difficult to classify, shares properties with amino acids that have aliphatic side chains (e.g., Leu, Val, Ile, and Ala). In certain circumstances, substitution of glutamine for glutamic acid or asparagine for aspartic acid may be considered a similar substitution in that glutamine and asparagine are amide derivatives of glutamic acid and aspartic acid, respectively. Conservative changes can also include the substitution of a chemically derivatized moiety for a non-derivatized residue, for example, by reaction of a functional side group of an amino acid. Variants and derivatives of proteins and peptides include forms having a limited number of one or more substituted residues.

An addition can be a covalent or non-covalent attachment of any type of molecule. Specific examples of additions include glycosylation, acetylation, phosphorylation, amidation, formylation, ubiquitination, and derivatization by protecting/blocking groups and any of numerous chemical modifications. Additional specific non-limiting examples of an addition are one or more additional amino acid residues. Accordingly, proteins, peptides, subsequences, portions, homologues, variants or derivatives thereof, can be a part of or contained within a larger molecule, such as another protein or peptide sequence, such as a fusion or chimera with a different (distinct) sequence.

In particular embodiments, an addition is a fusion (chimeric) sequence, an amino acid sequence having one or more molecules not normally present in a reference native (wild type) sequence covalently attached to the sequence. The term "chimeric" and grammatical variations thereof, when used in reference to a sequence, means that the sequence contains one or more portions that are derived from, obtained or isolated from, or based upon other physical or chemical entities. For example, a chimera of two or more different proteins may have one part a protein, peptide, subsequence, portion, homologue or variant thereof, and a second part of the chimera may be from a different sequence, or unrelated protein sequence.

Another particular example of a sequence having an amino acid addition is one in which a second heterologous sequence, i.e., heterologous functional domain is attached (covalent or non-covalent binding) that confers a distinct or complementary function. Heterologous functional domains are not restricted to amino acid residues. Thus, a heterologous functional domain can consist of any of a variety of different types of small or large functional moieties. Such moieties include nucleic acid, peptide, carbohydrate, lipid or small organic compounds, such as a drug (e.g., an antiviral), a metal (gold, silver), and radioisotope. For example, a tag such as T7 or polyhistidine can be attached in order to facilitate purification or detection of a protein, peptide, etc. Accordingly, there are provided proteins, peptides, subsequences, portions and homologues thereof (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or set forth in any of Tables 5-8), and a heterologous domain, wherein the heterologous functional domain confers a distinct function on the protein, peptide, subsequence, portion or homologue thereof.

Linkers, such as amino acid or peptidomimetic sequences may be inserted between the sequence and the addition (e.g., heterologous functional domain) so that the two entities maintain, at least in part, a distinct function or activity. Linkers may have one or more properties that include a flexible conformation, an inability to form an ordered secondary structure or a hydrophobic or charged character, which could promote or interact with either domain. Amino acids typically found in flexible protein regions include Gly, Asn and Ser. Other near neutral amino acids, such as Thr and Ala, may also be used in the linker sequence. The length of the linker sequence may vary without significantly affecting a function or activity of the fusion protein (see, e.g., U.S. Pat. No. 6,087,329). Linkers further include chemical moieties and conjugating agents, such as sulfo-succinimidyl derivatives (sulfo-SMCC, sulfo-SMPB), disuccinimidyl suberate (DSS), disuccinimidyl glutarate (DSG) and disuccinimidyl tartrate (DST).

Further non-limiting examples of additions are detectable labels. Thus, in another embodiment, the invention provides proteins, peptides, subsequences, portions and homologues thereof, that are detectably labeled. Specific examples of detectable labels include fluorophores, chromophores, radioactive isotopes (e.g., $S^{35}$, $P^{32}$, $I^{125}$), electron-dense reagents, enzymes, ligands and receptors. Enzymes are typically detected by their activity. For example, horseradish peroxidase is usually detected by its ability to convert a substrate such as 3,3-',5,5-'-tetramethylbenzidine (TMB) to a blue pigment, which can be quantified.

Another non-limiting example of an addition is an insertion of an amino acid within any protein, peptide, subsequence, portion or homologue thereof (e.g., any protein or sequence set forth herein, such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8). In particular embodiments, an insertion is of one or more amino acid residues inserted into the amino acid sequence of a protein or peptide, or subsequence, portion or homologue thereof, such as any Cockroach protein or peptide, such as Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8.

Modified and variant proteins, peptides, subsequences, portions or homologues thereof also include one or more D-amino acids substituted for L-amino acids (and mixtures thereof), structural and functional analogues, for example, peptidomimetics having synthetic or non-natural amino acids or amino acid analogues and derivatized forms. Modifications include cyclic structures such as an end-to-end amide bond between the amino and carboxy-terminus of the molecule or intra- or inter-molecular disulfide bond. Proteins, peptides, subsequences, portions and homologues thereof may be modified in vitro or in vivo, e.g., post-translationally modified to include, for example, sugar residues, phosphate groups, ubiquitin, fatty acids, lipids, etc.

Specific non-limiting examples of modified and variant proteins, peptides, subsequences, portions and homologues thereof include proteins or peptides comprising, consisting or consisting essentially of an amino acid sequence comprising at least one amino acid deletion from a full length Cockroach protein or amino acid sequence such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8. In particular embodiments, a protein, peptide, or subsequence, portion or homologue thereof is from about 2 to up to one amino acid less than the full length protein sequence. In additional particular embodiments, a protein subsequence or portion is from about 2 to 5, 5 to 10, 10 to 15, 15 to 20, 20 to 25, 25 to 50, 50 to 100 amino acids in length, provided that said subsequence or portion is at least one amino acid less in length than the full-length protein sequence.

The term "subsequence" or "portion" means a fragment or part of the full length molecule. A subsequence or portion therefore consists of one or more amino acids less than the full length protein or peptide. A subsequence or portion can have one or more amino acids less than the full length protein or peptide internally or terminal amino acid deletions from either amino or carboxy-termini. Subsequences and portions can vary in size. For example, a subsequence or portion of a protein or peptide can be as small as an epitope capable of binding an antibody (i.e., about five amino acids) up to a polypeptide that is one amino acid less than the entire length of a reference protein or peptide.

As used herein, subsequences and portions may also include or consist of one or more amino acid additions or deletions, wherein the subsequence or portion does not comprise the full length native/wild type protein or peptide sequence. Accordingly, total subsequence or portion lengths can be greater than the length of the full length native/wild type protein or peptide, for example, where a protein or peptide subsequence is fused or forms a chimera with another polypeptide.

The invention provides isolated and/or purified proteins, peptides, subsequences, portions, homologues, variants or derivatives thereof. In particular embodiments, isolated and/or purified proteins, peptides, subsequences, portions, homologues, variants or derivatives thereof, comprise, consist of or consist essentially of an amino acid sequence of a Cockroach protein or sequence set forth herein. In particular embodiments, the isolated and/or purified proteins, peptides, subsequences, portions, homologues, variants or derivatives thereof include a T cell epitope (e.g., Th2 cell epitope).

The term "isolated," when used as a modifier of a composition, means that the compositions are made by the hand of man or are separated, completely or at least in part, from their naturally occurring in vivo environment. Generally, isolated compositions are substantially free of one or more materials with which they normally associate with in nature, for example, one or more protein, nucleic acid, lipid, carbohydrate, cell membrane. The term "isolated" does not exclude alternative physical forms of the composition, such as fusions/chimeras, multimers/oligomers, modifications (e.g., phosphorylation, glycosylation, lipidation) or derivatized forms, or forms expressed in host cells produced by the hand of man.

An "isolated" composition (e.g., proteins, peptides, subsequences, portions, homologues, variants or derivatives thereof, for example, of any Cockroach protein or sequence set forth herein, or a Cockroach protein or peptide set forth in any of Tables 5-8 can also be "substantially pure" or "purified" when free of most or all of the materials with which it typically associates with in nature. Thus, an isolated protein, peptide, subsequence, portion, homologue, variant or derivative thereof, that also is substantially pure or purified does not include polypeptides or polynucleotides present among millions of other sequences, such as peptides of an peptide library or nucleic acids in a genomic or cDNA library, for example.

A "substantially pure" or "purified" composition can be combined with one or more other molecules. Thus, "substantially pure" or "purified" does not exclude combinations of compositions, such as combinations of proteins, peptides, subsequences, portions, homologues, variants or derivatives thereof (e.g., multiple proteins, peptides, subsequences, etc.), and other antigens, agents, drugs or therapies.

Proteins and peptide (e.g., antigens and allergens) can be prepared recombinantly, chemically synthesized, isolated from a biological material or source, and optionally modified, or any combination thereof. A biological material or source would include an organism that produced or possessed any proteins or peptide (e.g., antigen or allergen) set forth herein (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8). A biological material or source may further refer to a preparation in which the morphological integrity or physical state has been altered, modified or disrupted, for example, by dissection, dissociation, solubilization, fractionation, homogenization, biochemical or chemical extraction, pulverization, lyophilization, sonication or any other means of manipulating or processing a biological source or material. Subsequences, variants, homologues and derivatives can be prepared, for example, by substituting, deleting or adding one or more amino acid residues in the amino acid sequence of a protein, peptide, subsequence, portion or homologue thereof, and screening for biological activity, for example eliciting an immune response. A skilled person will understand how to make such derivatives or variants, using standard molecular biology techniques and methods, described for example in Sambrook et al. (2001) Molecular Cloning: a Laboratory Manual, $3^{rd}$ ed., Cold Spring Harbour Laboratory Press).

The invention also provides protein or peptide (e.g., proteins, peptides, a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8), immobilized on or attached to a substrate. The protein or peptide may comprise proteins, peptides, subsequences, portions, homologues, variants or derivatives thereof, for example, of any Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or any Cockroach protein or peptide set forth in any of Tables 5-8 can optionally have a unique or distinct position or address on the substrate.

Substrates to which protein or peptide (e.g., proteins, peptides, subsequences, portions, homologues, variants or derivatives thereof, for example, of any Cockroach allergen such as a protein or peptide of Bla g 1, Bla g 1.0101, Bla g 2, Bla g 4, Bla g 5, Bla g 6, Bla g 6.0101, Bla g 6.0201, Bla g 7, or a Cockroach protein or peptide set forth in any of Tables 5-8 or subsequences, portions, homologues, variants or derivatives thereof, can be immobilized or attached include essentially any physical entity such as a two dimensional surface that is permeable, semi-permeable or impermeable, either rigid or pliable and capable of either storing, binding to or having attached thereto or impregnated.

Substrates include dry solid medium (e.g., cellulose, polyester, nylon, or mixtures thereof etc.), such as glass, silica, plastic, polyethylene, polystyrene, polypropylene, polyacetate, polycarbonate, polyamide, polyester, polyurethane, or polyvinylchloride. Substrates include structures having sections, compartments, wells, containers, vessels or tubes, separated from each other to avoid or prevent cross-contamination or mixing with each other or with other reagents. Multi-well plates, which typically contain 6, 12, 26, 48, 96, to 1000 wells, are one particular non-limiting example of such a structure.

Substrates also include supports used for two- or three-dimensional arrays of sequences. The sequences are typically attached to the surface of the substrate (e.g., via a covalent bond) at defined positions (locations or addresses). Substrates can include a number of sequences, for example, 1, 2, 3, 4, 5, 5 to 10, 10 to 15, 15 to 20, 20 to 25, 25 to 30, 30 to 35, 35 to 40, 40 to 45, 45 to 50, 50 to 75, 75 to 100, 100 to 150, 150 to 200, 200 to 250, 250 to 300, up to all proteins, peptides, subsequences, portions, homologues, variants or derivatives thereof, such as a Cockroach protein or peptide set forth in any of Tables 5-8. Such substrates, also referred to as "arrays," can have any protein density; the greater the density the greater the number of sequences that can be screened on a given chip. Substrates that include a two- or three-dimensional array of sequences, and individual protein sequences therein, may be coded in accordance with the invention.

The invention also provides nucleic acids encoding proteins, peptides, subsequences, portions, homologues, variants or derivatives thereof, for example, of a Cockroach allergen, such as a protein or peptide of Bla g 1, Bla g 1.0101, Bla g 2, Bla g 4, Bla g 5, Bla g 6, Bla g 6.0101, Bla g 6.0201, Bla g 7, or a Cockroach protein or peptide set forth in any of Tables 5-8. Such nucleic acid sequences encode a sequence at least 40% or more (e.g., 45%, 50%, 55%, 60%, 65%, 70%, 75%, 80%, 85%, 90%, 95%, 96%, 97%, 98%, 99%) identical to an exemplary protein, peptide, subsequence, portion, homologue, variant or derivative thereof. In an additional embodiment, a nucleic acid encodes a sequence having a modification, such as one or more amino acid additions (insertions), deletions or substitutions of protein, peptide, subsequence, portion, homologue, variant or derivative thereof, or a Cockroach protein or peptide set forth in any of Tables 5-8.

The terms "nucleic acid," "polynucleotide" and "polynucleotide" and the like refer to at least two or more ribo- or deoxy-ribonucleic acid base pairs (nucleotides/nucleosides) that are linked through a phosphoester bond or equivalent. Nucleic acids include polynucleotides and polynucleotides. Nucleic acids include single, double or triplex, circular or linear, molecules. Exemplary nucleic acids include but are not limited to: RNA, DNA, cDNA, genomic nucleic acid, naturally occurring and non-naturally occurring nucleic acid, e.g., synthetic nucleic acid.

Nucleic acids can be of various lengths. Nucleic acid lengths typically range from about 20 bases to 20 Kilobases (Kb), or any numerical value or range within or encompassing such lengths, 10 bases to 10 Kb, 1 to 5 Kb or less, 1000 to about 500 bases or less in length. Nucleic acids can also be shorter, for example, 100 to about 500 bases, or from about 12 to 24, 24 to 45, 45 to 90, 90 to 250, or about 250 to 500 bases in length, or any numerical value or range or value within or encompassing such lengths. In particular aspects, a nucleic acid sequence has a length from about 10-20, 20-30, 30-50, 50-100, 100-150, 150-200, 200-250, 250-300, 300-400, 400-500, 500-1000, 1000-2000 bases, or any numerical value or range within or encompassing such lengths. Shorter nucleic acids are commonly referred to as "oligonucleotides" or "probes" of single- or double-stranded DNA. However, there is no upper limit to the length of such oligonucleotides.

Nucleic acid sequences further include nucleotide and nucleoside substitutions, additions and deletions, as well as derivatized forms and fusion/chimeric sequences (e.g., encoding recombinant polypeptide). For example, due to the degeneracy of the genetic code, nucleic acids include sequences and subsequences degenerate with respect to nucleic acids that encode proteins, peptides, subsequences, portions, homologues, variants or derivatives thereof, (e.g., substitutions, additions, insertions and deletions), for example, of a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8.

Nucleic acids can be produced using various standard cloning and chemical synthesis techniques. Techniques include, but are not limited to nucleic acid amplification, e.g., polymerase chain reaction (PCR), with genomic DNA or cDNA targets using primers (e.g., a degenerate primer mixture) capable of annealing to the encoding sequence. Nucleic acids can also be produced by chemical synthesis (e.g., solid phase phosphoramidite synthesis) or transcription from a gene. The sequences produced can then be translated in vitro, or cloned into a plasmid and propagated and then expressed in a cell (e.g., a host cell such as eukaryote or mammalian cell, yeast or bacteria, in an animal or in a plant).

Nucleic acid may be inserted into a nucleic acid construct in which expression of the nucleic acid is influenced or regulated by an "expression control element." An "expression control element" refers to a nucleic acid sequence element that regulates or influences expression of a nucleic acid sequence to which it is operatively linked. Expression control elements include, as appropriate, promoters, enhancers, transcription terminators, gene silencers, a start codon (e.g., ATG) in front of a protein-encoding gene, etc.

An expression control element operatively linked to a nucleic acid sequence controls transcription and, as appropriate, translation of the nucleic acid sequence. Expression control elements include elements that activate transcription constitutively, that are inducible (i.e., require an external signal for activation), or derepressible (i.e., require a signal to turn transcription off; when the signal is no longer present, transcription is activated or "derepressed"), or specific for cell-types or tissues (i.e., tissue-specific control elements).

Nucleic acid can also be inserted into a plasmid for propagation into a host cell and for subsequent genetic manipulation. A plasmid is a nucleic acid that can be propagated in a host cell, plasmids may optionally contain expression control elements in order to drive expression of the nucleic acid encoding proteins, peptides, subsequences, portions, homologues, variants or derivatives thereof in the host cell. A vector is used herein synonymously with a plasmid and may also include an expression control element for expression in a host cell (e.g., expression vector). Plasmids and vectors generally contain at least an origin of replication for propagation in a cell and a promoter. Plasmids and vectors are therefore useful for genetic manipulation and expression of proteins, peptides, subsequences, portions, homologues, variants or derivatives thereof, for example, a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8. Accordingly, vectors that include nucleic acids encoding or complementary to proteins, peptides, subsequences, portions, homologues, variants or derivatives thereof, for example, of a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8, are provided.

In accordance with the invention, there are provided particles (e.g., viral particles) and transformed host cells that express and/or are transformed with a nucleic acid that encodes and/or express proteins, peptides, subsequences, portions, homologues, variants or derivatives thereof, for example, of a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8. Particles and transformed host cells include but are not limited to virions, and prokaryotic and eukaryotic cells such as bacteria, fungi (yeast), plant, insect, and animal (e.g., mammalian, including primate and human, CHO cells and hybridomas) cells. For example, bacteria transformed with recombinant bacteriophage nucleic acid, plasmid nucleic acid or cosmid nucleic acid expression vectors; yeast transformed with recombinant yeast expression vectors; plant cell systems infected with recombinant virus expression vectors (e.g., cauliflower mosaic virus, CaMV; tobacco mosaic virus, TMV) or transformed with recombinant plasmid expression vectors (e.g., Ti plasmid); insect cell systems infected with recombinant virus expression vectors (e.g., baculovirus); and animal cell systems infected with recombinant virus expression vectors (e.g., retroviruses, adenovirus, vaccinia virus), or transformed animal cell systems engineered for stable expression. The cells may be a primary cell isolate, cell culture (e.g., passaged, established or immortalized cell line), or part of a plurality of cells, or a tissue or organ ex vivo or in a subject (in vivo).

The term "transformed" or "transfected" when used in reference to a cell (e.g., a host cell) or organism, means a genetic change in a cell following incorporation of an exogenous molecule, for example, a protein or nucleic acid (e.g., a transgene) into the cell. Thus, a "transfected" or "transformed" cell is a cell into which, or a progeny thereof in which an exogenous molecule has been introduced by the hand of man, for example, by recombinant DNA techniques.

The nucleic acid or protein can be stably or transiently transfected or transformed (expressed) in the host cell and progeny thereof. The cell(s) can be propagated and the introduced protein expressed, or nucleic acid transcribed. A progeny of a transfected or transformed cell may not be identical to the parent cell, since there may be mutations that occur during replication.

Expression of proteins, peptides, subsequences, portions, homologues, variants or derivatives thereof and nucleic acid in particles or introduction into target cells (e.g., host cells) can also be carried out by methods known in the art. Non-limiting examples include osmotic shock (e.g., calcium phosphate), electroporation, microinjection, cell fusion, etc. Introduction of nucleic acid and polypeptide in vitro, ex vivo and in vivo can also be accomplished using other techniques. For example, a polymeric substance, such as polyesters, polyamine acids, hydrogel, polyvinyl pyrrolidone, ethylenevinylacetate, methylcellulose, carboxymethylcellulose, protamine sulfate, or lactide/glycolide copolymers, polylactide/glycolide copolymers, or ethylenevinylacetate copolymers. A nucleic acid can be entrapped in microcapsules prepared by coacervation techniques or by interfacial polymerization, for example, by the use of hydroxymethylcellulose or gelatin-microcapsules, or poly (methylmethacrolate) microcapsules, respectively, or in a colloid system. Colloidal dispersion systems include macromolecule complexes, nanocapsules, microspheres, beads, and lipid-based systems, including oil-in-water emulsions, micelles, mixed micelles, and liposomes.

Liposomes for introducing various compositions into cells are known in the art and include, for example, phosphatidylcholine, phosphatidylserine, lipofectin and DOTAP (e.g., U.S. Pat. Nos. 4,844,904, 5,000,959, 4,863,740, and 4,975,282; and GIBCO-BRL, Gaithersburg, Md.). Piperazine based amphilic cationic lipids useful for gene therapy also are known (see, e.g., U.S. Pat. No. 5,861,397). Cationic lipid systems also are known (see, e.g., U.S. Pat. No. 5,459,127). Polymeric substances, microcapsules and colloidal dispersion systems such as liposomes are collectively referred to herein as "vesicles." Accordingly, viral and non-viral vector means delivery into cells are included.

Cockroach proteins, peptides, subsequences, portions, homologues, variants or derivatives thereof, for example, a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8, are provided, can be employed in various methods and uses and medicaments. Such methods and uses and medicaments include, for example, administration in vitro and in vivo of one or more proteins, peptides, subsequences, portions, homologues, variants or derivatives thereof, such as protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8, or subsequences, portions, homologues, variants or derivatives thereof.

The methods and uses and medicaments provided include methods and uses and medicaments for modulating an immune response, including, among others, methods and uses and medicaments for protecting and treating subjects against a disorder, disease; and methods and uses of and medicaments for providing specific immunotherapy; and methods and uses of detection and diagnosis.

In particular embodiments, methods and uses include administration or delivery of a protein, peptide, subsequence, portion, homologue, variants or derivative thereof described herein (e.g., of any Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8) to modulate an immune response in a subject, including, for example, modulating an immune response to an allergen or antigen.

As used herein, the term "modulate," means an alteration or effect on the term modified. For example, the term modulate can be used in various contexts to refer to an alteration or effect of an activity, a function, or expression of a polypeptide, gene or signaling pathway, or a physiological condition or response of an organism. In certain embodiments, modulating involves decreasing, reducing, inhibiting, suppressing or disrupting an immune response of a subject to an antigen or allergen. In other embodiments, modulating involves eliciting, stimulating, inducing, promoting, increasing or enhancing an immune response of a subject to an antigen or allergen. Thus, where the term "modulate" is used to modify the term "immune response against an allergen in a subject" this means that the immune response in the subject to the allergen is altered or affected (e.g., decreased, reduced, inhibited, suppressed, limited, controlled, prevented, elicited, promoted, stimulated, increased, induced, enhanced, etc.).

Methods and uses and medicaments for modulating an immune response against an antigen or allergen as described herein may be used to provide a subject with protection against an allergic response or reaction to the allergen, or allergic disorder or allergic disease, or one or more physiological conditions, disorders, illnesses, diseases, symptoms or complications caused by or associated with the allergen. Accordingly, in other embodiments, methods and uses include administering a protein, peptide, subsequence, portion, homologue, variant or derivative thereof described herein (e.g., of any Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8) to protect or treat a subject against an allergic response, allergic disorder or allergic disease, or one or more physiological conditions, disorders, illnesses, diseases, symptoms or complications caused by or associated with an allergen. In still other embodiments, methods and uses include administering or delivering a protein, peptide, subsequence, portion, homologue, variant or derivative thereof described herein (e.g., of any Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8) to elicit, stimulate, induce, promote, increase or enhance immunological tolerance of a subject to an antigen or allergen.

In various embodiments, there are provided methods and uses of and medicaments for providing a subject with protection against an allergic response, allergic disorder or allergic disease, or one or more physiological conditions, disorders, illnesses, diseases, symptoms or complications caused by or associated with an allergen. In various aspects, a method or use includes administering to the subject an amount of a protein, peptide, subsequence, portion, homologue, variant or derivative thereof described herein (e.g., any Cockroach allergen such as a protein or peptide Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8) sufficient to provide the subject with protection against the allergic response, allergic disorder or allergic disease, or one or more physiological conditions, disorders, illnesses, diseases, symptoms or complications caused by or associated with the allergen.

Methods and uses and medicaments of the invention include providing a subject with protection against an antigen or allergen, or one or more physiological conditions, disorders, illnesses, diseases, symptoms or complications caused by or associated with the exposure to the antigen or allergen, for example, vaccinating the subject to protect against an allergic response to the allergen, for example with any Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8. In certain embodiments, methods and uses include protecting the subject against an allergic response or reaction by inducing tolerance of the subject (desensitizing) to the allergen.

As used herein, the terms "protection," "protect" and grammatical variations thereof, when used in reference to an allergic response or one or more physiological conditions, disorders, illnesses, diseases, symptoms or complications caused by or associated with the exposure to allergen, means preventing an allergic response, reaction, or one or more physiological conditions, disorders, illnesses, diseases, symptoms or complications caused by or associated with the exposure to the allergen, or reducing or decreasing susceptibility to an allergic response, reaction, or one or more physiological conditions, disorders, illnesses, diseases, symptoms or complications caused by or associated with the exposure to the allergen.

An allergic response includes but is not limited to an allergic reaction, hypersensitivity, an inflammatory response or inflammation. In certain embodiments allergic response may involve one or more of cell infiltration, production of antibodies, production of cytokines, lymphokines, chemokines, interferons and interleukins, cell growth and maturation factors (e.g., differentiation factors), cell proliferation, cell differentiation, cell accumulation or migration (chemotaxis) and cell, tissue or organ damage or remodeling. In particular aspects, an allergic response may include Allergic rhinitis; Onchocercal dermatitis; Atopic dermatitis; allergic conjunctivitis; Drug reactions; Nodules, eosinophilia, rheumatism, dermatitis, rashes, hives, and swelling (NERDS); esophageal and a gastrointestinal allergy.

Allergic responses can occur systemically, or locally in any region, organ, tissue, or cell. In particular aspects, an allergic response occurs in the skin, the upper respiratory tract, the lower respiratory tract, pancreas, thymus, kidney, liver, spleen, muscle, nervous system, skeletal joints, eye, mucosal tissue, gut or bowel.

Methods and uses and medicaments herein include treating a subject for an allergic response, allergic disorder or allergic disease, as well as one or more physiological conditions, disorders, illnesses, diseases, symptoms or complications caused by or associated with an allergen. Such methods and uses include administering to a subject an amount of a protein, peptide, subsequence, portion, homologue, variant or derivative thereof described herein (e.g., any Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8) sufficient to treat the subject for the allergic response, allergic disorder or allergic disease, or one or more physiological conditions, disorders, illnesses, diseases, symptoms or complications caused by or associated with the allergen.

As will be understood by a person skilled in the art, treating an allergic response, allergic disorder or allergic disease, or one or more physiological conditions, disorders, illnesses, diseases, symptoms or complications caused by or associated with an allergen may include decreasing, reducing, inhibiting, suppressing, limiting, controlling or clearing an allergic response, an allergic disorder or allergic disease, or one or more physiological conditions, disorders, illnesses, diseases, symptoms or complications caused by or associated with the allergen. Thus in certain embodiments, a method or use of treating a subject for a an allergic response, allergic disorder or allergic disease, or one or more physiological conditions, disorders, illnesses, diseases, symptoms or complications caused by or associated with an allergen comprises elimination of the allergic response, allergic disorder or allergic disease, or one or more physiological conditions, disorders, illnesses, diseases, symptoms or complications caused by or associated with the allergen from a subject. In other embodiments, a method or use of treating a subject for an allergic response, allergic disorder or allergic disease, or one or more physiological conditions, disorders, illnesses, diseases, symptoms or complications caused by or associated with an allergen includes reducing occurrence, frequency, severity, progression, or duration of the allergic response, allergic disorder or allergic disease, or one or more physiological conditions, disorders, illnesses, diseases, symptoms or complications caused by or associated with the allergen in the subject. In yet another embodiment, a method or use of treating a subject for an allergic response, allergic disorder or allergic disease, or one or more physiological conditions, disorders, illnesses, diseases, symptoms or complications caused by or associated with an allergen, includes stabilizing the allergic response, allergic disorder or allergic disease, or one or more physiological conditions, disorders, illnesses, diseases, symptoms or complications caused by or associated with the allergen in a subject by preventing an increase in the occurrence, frequency, severity, progression, or duration of the allergic response, allergic disorder or allergic disease, or one or more physiological conditions, disorders, illnesses, diseases, symptoms or complications caused by or associated with contact of the subject with an allergen.

Methods and uses and medicaments of the invention include treating or administering a subject previously exposed to an antigen or allergen. Thus, in certain embodiments, methods and uses and medicaments are for treating or protecting a subject from an allergic response, allergic disorder or allergic disease, or one or more physiological conditions, disorders, illnesses, diseases, symptoms or complications caused by or associated with secondary or subsequent exposure to an antigen or allergen.

Physiological conditions, disorders, illnesses, diseases, symptoms or complications caused by or associated with an antigen/allergen treatable in accordance with the invention methods and uses and medicaments include but are not limited to asthma, allergic asthma, bronchiolitis and pleuritis, Allergic rhinitis; Onchocercal dermatitis; Atopic dermatitis; allergic conjunctivitis; Drug reactions; Nodules, eosinophilia, rheumatism, dermatitis, rashes, hives, and swelling (NERDS); esophageal and a gastrointestinal allergy, Airway Obstruction, Apnea, Asbestosis, Atelectasis, Berylliosis, Bronchiectasis, Bronchiolitis, Bronchiolitis Obliterans Organizing Pneumonia, Bronchitis, Bronchopulmonary Dysplasia, Empyema, Pleural Empyema, Pleural Epiglottitis, Hemoptysis, Hypertension, Kartagener Syndrome, Meconium Aspiration, Pleural Effusion, Pleurisy, Pneumonia, Pneumothorax, Respiratory Distress Syndrome, Respiratory Hypersensitivity, Rhinoscleroma, Scimitar Syndrome, Severe Acute Respiratory Syndrome, Silicosis, Tracheal Stenosis, eosinophilic pleural effusions, Histiocytosis; chronic eosinophilic pneumonia; hypersensitivity pneumonitis; Allergic bronchopulmonary aspergillosis; Sarcoidosis; Idiopathic pulmonary fibrosis; pulmonary edema; pulmonary embolism; pulmonary emphysema; Pulmonary Hyperventilation; Pulmonary Alveolar Proteinosis; Chronic Obstructive Pulmonary Disease (COPD); Interstitial Lung Disease; and Topical eosinophilia.

Cockroach proteins, peptides, subsequences, portions, homologues, variants and derivatives thereof, described herein may elicit, stimulate, induce, promote, increase or enhance immunological tolerance to an antigen, including an allergen. Methods and uses and medicaments of the invention therefore further include inducing immunological tolerance of a subject to an antigen or allergen. Thus, for example, Cockroach proteins, peptides, subsequences, portions, homologues, variants and derivatives thereof, described herein can be effective in treatment (e.g., therapeutic) of an allergic immune response, including but not limited to an allergic immune response following a secondary or subsequent exposure of a subject to an antigen (allergen). In one embodiment, a method or use includes administering to the subject an amount of a protein, peptide, subsequence, portion, homologue, variant or derivative thereof described herein (e.g., any Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8) sufficient to induce tolerance in the subject to the antigen or allergen. In particular aspects, the immunological tolerance elicited, stimulated, induced, promoted, increased or enhanced may involve modulation of T cell activity, including but not limited to CD4+ T cells, CD8+ T cells, Th1 cells, Th2 cells and regulatory T cells. For example, immunological tolerance elicited, stimulated, induced, promoted, increased or enhanced from administration of the Cockroach proteins or peptides, or subsequence, portion, homologue, variant or derivative thereof, may involve modulation of the production or activity of pro-inflammatory or anti-inflammatory cytokines produced by T cells.

In additional embodiments, a method or use of inducing immunological tolerance in a subject to an allergen includes a reduction in occurrence, frequency, severity, progression, or duration of physiological conditions, disorders, illnesses, diseases, symptoms or complications caused by or associated an allergic response to the allergen in the subject. Thus, in certain embodiments, inducing immunological tolerance can protect a subject against or treat a subject for an allergic response, allergic disorder or allergic disease, or one or more physiological conditions, disorders, illnesses, diseases, symptoms or complications caused by or associated with an antigen or allergen.

Methods and uses and medicaments for inducing immunological tolerance (desensitizing) described herein may include eliciting, stimulating, inducing, promoting, increasing or enhancing an immune response. In certain embodiments, inducing immunological tolerance may include eliciting, stimulating, inducing, promoting, increasing or enhancing an immune response that decreases, reduces, inhibits, suppresses, limits, controls or clears an allergic response. For example, in certain embodiments inducing immunological tolerance may include eliciting, stimulating, inducing, promoting, increasing or enhancing proliferation or activity of regulatory T cells. In other embodiments, inducing immunological tolerance may include eliciting, stimulating, inducing, promoting, increasing or enhancing an immune response that promotes an allergic response. As will be understood by a person of skill in the art, a method or use that elicits, stimulates, induces, promotes, increases or enhances an immune response that promotes an allergic response may still induce immunological tolerance by also eliciting, stimulating, inducing, promoting, increasing or enhancing an immune response that decreases, reduces, inhibits, suppresses, limits, controls or clears an allergic response. In particular embodiments, inducing immunological tolerance includes eliciting, stimulating, inducing, promoting, increasing or enhancing an immune responses that decreases, reduces, inhibits, suppresses, limits, controls or clears an allergic response that is stronger than the immune response that promotes an allergic response. In other embodiments, inducing immunological tolerance includes eliciting, stimulating, inducing, promoting, increasing or enhancing more immune responses that decrease, reduce, inhibit, suppress, limit, controls or clear an allergic response than immune responses that promote an allergic response.

Methods and uses and medicaments of the invention include treating a subject via specific immunotherapy. In one embodiment, a method or use includes administering to the subject an amount of a protein, peptide, subsequence, portion, homologue, variant or derivative thereof described herein (e.g., any Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8). In one aspect, an antigen (allergen) administered to a subject during specific immunotherapy to treat the subject is the same antigen (allergen) to which the subject has been sensitized or is hypersensitive (e.g., allergic). In another non-limiting aspect, an antigen (allergen) administered to a subject to treat the subject is a different antigen (allergen) to which the subject has been sensitized or is hypersensitive (e.g., allergic). Thus, in different embodiments, the antigen administered and antigen (e.g., allergen) against which immunological tolerance is sought may be the same protein (antigen, allergen), may be proteins (antigens, allergens) of the same organism or may be proteins (antigens, allergens) of different organisms.

In accordance with the invention, methods and uses and medicaments include therapeutic (following antigen/allergen exposure) and prophylactic (prior to antigen/allergen exposure) uses and methods. For example, therapeutic and prophylactic methods and uses of treating a subject for an allergic response, allergic disorder or allergic disease, or one or more physiological conditions, disorders, illnesses, diseases, symptoms or complications caused by or associated with an allergen, include but are not limited to treatment of a subject having or at risk of having an allergic response, allergic disorder or allergic disease, or one or more physiological conditions, disorders, illnesses, diseases, symptoms or complications caused by or associated with an allergen; treating a subject with an allergic response, allergic disorder or allergic disease, or one or more physiological conditions, disorders, illnesses, diseases, symptoms or complications caused by or associated with an allergen; and methods and uses and medicaments of protecting a subject from an allergic response, allergic disorder or allergic disease, or one or more physiological conditions, disorders, illnesses, diseases, symptoms or complications caused by or associated with an antigen/allergen (e.g., provide the subject with protection against an allergic reaction to an allergen), to decrease or reduce the probability of an allergic response, allergic disorder or allergic disease, or one or more physiological conditions, disorders, illnesses, diseases, symptoms or complications caused by or associated with an allergen, in a subject and to decrease or reduce susceptibility of a subject to an allergic response, allergic disorder or allergic disease, or one or more physiological conditions, disorders, illnesses, diseases, symptoms or complications caused by or associated with an allergen, to inhibit or prevent an allergic response, allergic disorder or allergic disease, or one or more physiological conditions, disorders, illnesses, diseases, symptoms or complications caused by or associated with an allergen, in a subject. Accordingly, methods and uses and medicaments can treat an allergic response, allergic disorder or allergic disease, or one or more physiological conditions, disorders, illnesses, diseases, symptoms or complications caused by or associated with an allergen, or provide a subject with protection from an allergic response, allergic disorder or allergic disease, or one or more physiological conditions, disorders, illnesses, diseases, symptoms or complications caused by or associated with an allergen (e.g., prophylactic protection).

As described herein, proteins, peptides, subsequences, portions, homologues, variants and derivatives thereof include T cell epitopes, such as Th2 cell epitopes. Accordingly, methods and uses of the invention include administering an amount of a protein, peptide, subsequence, portion, homologue, variant or derivative thereof (e.g., a T cell epitope) to a subject sufficient to provide the subject with protection against an allergic response, allergic disorder or allergic disease, or one or more physiological conditions, disorders, illnesses, diseases, symptoms or complications caused by or associated with an allergen. In another embodiment, a method includes administering an amount of a protein, peptide, subsequence, portion, homologue, variant or derivative thereof (e.g., a T cell epitope, such as a Th2 cell epitope) to a subject sufficient to treat, vaccinate or immunize the subject against an allergic response, allergic disorder or allergic disease, or one or more physiological conditions, disorders, illnesses, diseases, symptoms or complications caused by or associated with an allergen.

In accordance with the invention, methods and uses of modulating anti-allergen activity of T cells, including but not limited to $CD8^+$ T cells, $CD4^+$ T cells, Th1 cells or Th2 cells, in a subject are provided. In one embodiment, a method or use includes administering to a subject an amount of a protein, peptide, subsequence, portion, homologue, variant or derivative thereof (e.g., a Cockroach protein or peptide set forth in any of Tables 5-8), such as a T cell epitope, sufficient to modulate Th2 cell activity in the subject.

In all methods and uses and medicaments of the invention, any appropriate protein, peptide, subsequence, portion, homologue, variant or derivative thereof can be used or administered. In particular non-limiting examples, the protein, peptide, subsequence, portion, homologue, variant or derivative thereof comprises, consists of or consists essentially of a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8, or a subsequence, portion, homologue, variant or derivative thereof.

In certain embodiments, two or more proteins, peptides, subsequences, portions, homologues, variants or derivatives thereof, may be administered to a subject. In particular embodiments, a protein, peptide, subsequence, portion, homologue, variant or derivative thereof consists of or consists essentially of an amino acid sequence of a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8, or subsequence, portion, homologue, variant or derivative thereof, and is administered with one or more other proteins, peptides, subsequences, portions, homologues, variants or derivatives thereof. Two or more proteins, peptides, subsequences, portions, homologues, variants or derivatives thereof may be administered as a combination composition, or administered separately, such as concurrently or in series or sequentially. Different proteins, peptides, subsequences, portions, homologues, variants or derivatives thereof, may be administered to a subject in the same amount, volume or concentration, or different amounts, volumes or concentrations. Thus, in certain embodiments, the subject may be administered the same amount of two or more different proteins, peptides, subsequences, portions, homologues, variants or derivatives thereof; and in other embodiments, the subject may be administered one protein, peptide, subsequence, portion, homologue, variant or derivative thereof in an amount, volume or concentration greater than one or more other protein, peptide, subsequence, portion, homologue, variant or derivative thereof administered to the subject.

Methods and uses of the invention include a favorable response or an improvement in one or more physiological conditions, disorders, illnesses, diseases, symptoms or complications caused by or associated with an antigen/allergen. In particular embodiments, a favorable response or improvement includes but is not limited to reduce, decrease, suppress, limit, control or inhibit an allergic response including reducing, decreasing, suppressing, limiting, controlling or inhibiting immune cell proliferation, function or activity, or eliciting, stimulating, inducing, promoting, increasing or enhancing immune cell proliferation or activity (e.g. regulatory T cells); or reduce, decrease, suppress, limit, control or inhibit the amount of allergen. In additional particular embodiments, an amount of a protein, peptide, subsequence, portion, homologue, variant or derivative thereof is sufficient to elicit, stimulate, induce, promote, increase or enhance or augment immunological tolerance to an allergen; or decrease, reduce, inhibit, suppress, prevent, control, or limit an allergic reaction or response. In further particular embodiments, an amount of a protein, peptide, subsequence, portion, homologue, variant or derivative thereof is sufficient to protect a subject from an allergic response or reduce, decrease, limit, control or inhibit susceptibility to an allergic response, allergic disorder or allergic disease, or one or more physiological conditions, disorders, illnesses, diseases, symptoms or complications caused by or associated with an allergen.

Methods and uses of the invention therefore include any therapeutic or beneficial effect. In various methods embodiments, an allergic response, allergic disorder or allergic disease, or one or more physiological conditions, disorders, illnesses, diseases, symptoms or complications caused by or associated with an allergen is reduced, decreased, inhibited, limited, delayed or prevented. Physiological conditions, disorders, illnesses and diseases associated with an antigen/allergen include but are not limited to asthma, allergic asthma, bronchiolitis and pleuritis, Allergic rhinitis; Onchocercal dermatitis; Atopic dermatitis; allergic conjunctivitis; Drug reactions; Nodules, eosinophilia, rheumatism, dermatitis, rashes, hives, and swelling (NERDS); esophageal and a gastrointestinal allergy, Airway Obstruction, Apnea, Asbestosis, Atelectasis, Berylliosis, Bronchiectasis, Bronchiolitis, Bronchiolitis Obliterans Organizing Pneumonia, Bronchitis, Bronchopulmonary Dysplasia, Empyema, Pleural Empyema, Pleural Epiglottitis, Hemoptysis, Hypertension, Kartagener Syndrome, Meconium Aspiration, Pleural Effusion, Pleurisy, Pneumonia, Pneumothorax, Respiratory Distress Syndrome, Respiratory Hypersensitivity, Rhinoscleroma, Scimitar Syndrome, Severe Acute Respiratory Syndrome, Silicosis, Tracheal Stenosis, eosinophilic pleural effusions, Histiocytosis; chronic eosinophilic pneumonia; hypersensitivity pneumonitis; Allergic bronchopulmonary aspergillosis; Sarcoidosis; Idiopathic pulmonary fibrosis; pulmonary edema; pulmonary embolism; pulmonary emphysema; Pulmonary Hyperventilation; Pulmonary Alveolar Proteinosis; Chronic Obstructive Pulmonary Disease (COPD); Interstitial Lung Disease; and Topical eosinophilia. Symptoms and complications associated with an allergen include but are not limited to cell infiltration, production of antibodies, production of cytokines, lymphokines, chemokines, interferons and interleukins, cell growth and maturation factors (e.g., differentiation factors), cell proliferation, cell differentiation, cell accumulation or migration and cell, tissue or organ damage or remodelling, allergic rhinitis; Onchocercal dermatitis; Atopic dermatitis; allergic conjunctivitis; Drug reactions; Nodules, eosinophilia, rheumatism, dermatitis, rashes, hives, and swelling (NERDS); esophageal and a gastrointestinal allergy. Additional symptoms of antigen/allergen exposure are known to one of skill in the art and treatment thereof in accordance with the invention is provided.

Methods and uses of the invention moreover include reducing, decreasing, inhibiting, delaying or preventing onset, progression, frequency, duration, severity, probability or susceptibility of one or more adverse symptoms, disorders, illnesses, diseases or complications caused by or associated with an antigen/allergen (e.g., any Cockroach allergen). In further various particular embodiments, methods and uses include improving, accelerating, facilitating, enhancing, augmenting, or hastening recovery of a subject from an allergic response, allergic disorder or allergic disease, or one or more physiological conditions, disorders, illnesses, diseases, symptoms or complications caused by or associated with an antigen/allergen. In yet additional various embodiments, methods and uses include stabilizing an allergic response, allergic disorder or allergic disease, or one or more physiological conditions, disorders, illnesses, diseases, symptoms or complications caused by or associated with an antigen/allergen (e.g., any Cockroach allergen).

A therapeutic or beneficial effect is therefore any objective or subjective measurable or detectable improvement or benefit provided to a particular subject. A therapeutic or beneficial effect can but need not be complete ablation of all or any allergic response, allergic disorder or allergic disease, or one or more physiological conditions, disorders, illnesses, diseases, symptoms or complications caused by or associated with an allergen. Thus, a satisfactory clinical endpoint is achieved when there is an incremental improvement or a partial reduction in an allergic response, allergic disorder or allergic disease, or one or more physiological conditions, disorders, illnesses, diseases, symptoms or complications caused by or associated with an allergen, or an inhibition, decrease, reduction, suppression, prevention, limit or control of worsening or progression of an allergic response, allergic disorder or allergic disease, or one or more physiological conditions, disorders, illnesses, diseases, symptoms or complications caused by or associated with an allergen, over a short or long duration (hours, days, weeks, months, etc.).

A therapeutic or beneficial effect also includes reducing or eliminating the need, dosage frequency or amount of a second therapeutic protocol or active such as another drug or other agent (e.g., anti-inflammatory) used for treating a subject having or at risk of having an allergic response, allergic disorder or allergic disease, or one or more physiological conditions, disorders, illnesses, diseases, symptoms or complications caused by or associated with an allergen. For example, reducing an amount of an adjunct therapy, such as a reduction or decrease of a treatment for an allergic response, allergic disorder or allergic disease, or one or more physiological conditions, disorders, illnesses, diseases, symptoms or complications caused by or associated with an allergen, or a specific immunotherapy, vaccination or immunization protocol is considered a beneficial effect. In addition, reducing or decreasing an amount of protein, peptide, subsequence, portion, homologue, variant or derivative thereof, used for specific immunotherapy, vaccination or immunization of a subject to provide protection to the subject is considered a beneficial effect.

As disclosed herein, invention proteins, peptides, subsequences, etc., can be used in methods of providing specific immunotherapy to a subject, such as a subject with or at risk of an allergic response, allergic disorder or allergic disease, or one or more physiological conditions, disorders, illnesses, diseases, symptoms or complications caused by or associated with an allergen. In one embodiment, a method or use includes administering to a subject an amount of a protein, peptide, subsequence, portion, homologue, variant or derivative thereof sufficient to elicit, stimulate, induce, promote, increase, enhance or augment immunological tolerance in the subject to an antigen/allergen. In another embodiment, a method includes administering to a subject an amount of a nucleic acid encoding all or a portion (e.g., a T cell epitope) of a protein, peptide, subsequence, portion, homologue, variant or derivative thereof sufficient to elicit, stimulate, induce, promote, increase, enhance or augment immunological tolerance of the subject to an allergen.

When an antigen(s) or allergen(s) is administered to induce tolerance (desensitize), an amount or dose of the antigen or allergen to be administered (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8), and the period of time required to achieve a desired outcome or result (e.g., to desensitize or develop tolerance to the antigen or allergen) can be determined by one skilled in the art. The antigen or allergen may be administered to the patient through any route known in the art, including, but not limited to oral, inhalation, sublingual, epicutaneous, intranasal, and/or parenteral routes (intravenous, intramuscular, subcutaneously, and intraperitoneal).

Methods and uses of the invention include administration of a protein, peptide, subsequence, portion, homologue, variant or derivative thereof to a subject prior to contact by or exposure to an allergen; administration prior to, substantially contemporaneously with or after a subject has been contacted by or exposed to an allergen; and administration prior to, substantially contemporaneously with or after an allergic response, allergic disorder or allergic disease, or one or more physiological conditions, disorders, illnesses, diseases, symptoms or complications caused by or associated with an allergen. A subject contacted by or exposed to an allergen may have contact or exposure over a period of 1-5, 5-10, 10-20, 20-30, 30-50, 50-100 hours, days, months, or years.

Invention compositions (e.g., proteins, peptides, subsequences, portions, homologues, variants or derivatives thereof, including T cell epitopes, for example, of an amino acid sequence of a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8), methods and uses and medicaments can be combined with any compound, agent, drug, treatment or other therapeutic regimen or protocol having a desired therapeutic, beneficial, additive, synergistic or complementary activity or effect. Exemplary combination compositions and treatments include multiple proteins, peptides, subsequences, portions, homologues, variants or derivatives thereof, such as a combination of any of the Cockroach proteins and peptides set forth herein, and/or a combination of any of the subsequences, portions, homologues, variants or derivatives thereof.

Additional combinations include second actives, such as anti-allergen compounds, agents, drugs, treatments and therapies, including but not limited to anti-histamines, anti-inflammatories, decongestants and corticosteroids as well as agents that assist, promote, stimulate or enhance efficacy. Such anti-allergen drugs, agents, treatments and therapies can be administered or performed prior to, substantially contemporaneously with or following any method or use described herein, for example, a therapeutic use or method of treating a subject for an allergic response, allergic disorder or allergic disease, or one or more physiological conditions, disorders, illnesses, diseases, symptoms or complications caused by or associated with an allergen, or a method or use of providing specific immunotherapy to a subject.

Accordingly, methods and uses and medicaments include combinations of Cockroach proteins, peptides, subsequences, portions, homologues, variants and/or derivatives thereof (second, third, fourth, fifth or more), and/or second actives, and administering as a combination, or administered separately, such as concurrently or in series or sequentially (prior to or following) to administering another (second, third, fourth, fifth or more) Cockroach protein, peptide, subsequence, portios, homolog, variant and/or derivative thereof, and/or second active to a subject. The invention therefore provides combinations of one or more proteins, peptides, subsequences, portions, homologues, variants or derivatives thereof, in combination, and/or with a second active, including but not limited to any compound, agent, drug, therapeutic regimen, treatment protocol, process, remedy or composition, such as anti-histamine, anti-inflammatory, decongestant and corticosteroid, or immune tolerance stimulating, enhancing or augmenting protocol, or specific immunotherapy protocol set forth herein or known in the art. The compound, agent, drug, therapeutic regimen, treatment protocol, process, remedy or composition can be administered or performed prior to, substantially contemporaneously with or following administration of one or more proteins, peptides, subsequences, portions, homologues, variants or derivatives thereof, or a nucleic acid encoding all or a portion (e.g., a T cell epitope) of a protein, peptide, subsequence, portion, homologue, variant or derivative thereof, to a subject. Specific non-limiting examples of combination embodiments therefore include the foregoing or other compound, agent, drug, therapeutic regimen, treatment protocol, process, remedy or composition.

An exemplary combination is a Cockroach protein, peptide, subsequence, portion, homologue, variant or derivative thereof, and a different protein, peptide, or subsequence, portion, homologue, variant or derivative thereof, of an amino acid sequence of a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8. Another exemplary combination is a protein, peptide, subsequence, portion, homologue, variant or derivative thereof, and an immunological tolerance inducing molecule.

In invention methods and uses in which there is a desired outcome or effect, such as a therapeutic or prophylactic method or use that provides a benefit from treatment, protection, inducing immunological tolerance, vaccination or specific immunotherapy, a Cockroach protein, peptide, subsequence, portion, homologue, variant or derivative thereof (e.g., a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8) can be administered in a sufficient or effective amount. As used herein, a "sufficient amount" or "effective amount" or an "amount sufficient" or an "amount effective" refers to an amount that provides, in single (e.g., primary) or multiple (e.g., booster) doses, alone or in combination with one or more other compounds, treatments, therapeutic regimens or agents (e.g., a drug), a long term or a short term detectable or measurable improvement in a given subject or any objective or subjective benefit to a given subject of any degree or for any time period or duration (e.g., for minutes, hours, days, months, years, or cured).

An amount sufficient or an amount effective can but need not be provided in a single administration and can but need not be achieved by a particular protein, peptide, subsequence, portion, homologue, variant or derivative thereof, alone, optionally in a combination composition or method or use that includes a second active. In addition, an amount sufficient or an amount effective need not be sufficient or effective if given in single or multiple doses without a second or additional administration or dosage, since additional doses, amounts or duration above and beyond such doses, or additional antigens, compounds, drugs, agents, treatment or therapeutic regimens may be included in order to provide a given subject with a detectable or measurable improvement or benefit to the subject. For example, to increase, enhance, improve or optimize specific immunotherapy, after an initial or primary administration of one or more proteins, peptides, subsequences, portions, homologues, variants or derivative thereof, the subject can be administered one or more additional "boosters" of one or more proteins, peptides, subsequences, portions, homologues, variants or derivatives thereof. Such subsequent "booster" administrations can be of the same or a different type, formulation, dose, concentration, route, etc.

An amount sufficient or an amount effective need not be therapeutically or prophylactically effective in each and every subject treated, nor a majority of subjects treated in a given group or population. An amount sufficient or an amount effective means sufficiency or effectiveness in a particular subject, not a group of subjects or the general population. As is typical for such methods, different subjects will exhibit varied responses to a method of the invention, such as immunization, vaccination, specific immunotherapy and therapeutic treatments.

The term "subject" includes but is not limited to a subject at risk of allergen contact or exposure as well as a subject that has been contacted by or exposed to an allergen. A subject also includes those having or at risk of having or developing an immune response to an antigen or an allergen. Such subjects include mammalian animals (mammals), such as a non-human primate (apes, gibbons, gorillas, chimpanzees, orangutans, macaques), a domestic animal (dogs and cats), a farm animal (poultry such as chickens and ducks, horses, cows, goats, sheep, pigs), experimental animal (mouse, rat, rabbit, guinea pig) and humans. Subjects include animal disease models, for example, mouse and other animal models of allergic response known in the art.

Accordingly, subjects appropriate for treatment include those having or at risk of exposure to an antigen or allergen, also referred to as subjects in need of treatment. Subjects in need of treatment therefore include subjects that have been exposed to or contacted with an antigen or allergen, or that have an ongoing contact or exposure or have developed one or more adverse symptoms caused by or associated with an antigen or allergen, regardless of the type, timing or degree of onset, progression, severity, frequency, duration of the symptoms.

Target subjects and subjects in need of treatment also include those at risk of allergen exposure or contact or at risk of having exposure or contact to an allergen. Accordingly, subjects include those at increased or elevated (high) risk of an allergic reaction; has, or has previously had or is at risk of developing hypersensitivity to an allergen; and those that have or have previously had or is at risk of developing asthma.

More particular target subjects include subjects allergic to particular Cockroach antigens and/or allergens. In particular embodiments, a subject is allergic to a Cockroach allergen, such as a Cockroach protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16.

Invention compositions, methods and uses and medicaments are therefore applicable to treating a subject who is at risk of allergen exposure or contact but has not yet been exposed to or contacted with the allergen. Prophylactic uses and methods are therefore included. Target subjects for prophylaxis may be at increased risk (probability or susceptibility) of allergen exposure or contact as set forth herein. Such subjects are considered in need of treatment due to being at risk.

Subjects for prophylaxis need not be at increased risk but may be from the general population in which it is desired to protect a subject against an allergic response, allergic disorder or allergic disease, or one or more physiological conditions, disorders, illnesses, diseases, symptoms or complications caused by or associated with an allergen or to provide specific immunotherapy, for example. Such a subject that is desired to be protected against an allergic response, allergic disorder or allergic disease, or one or more physiological conditions, disorders, illnesses, diseases, symptoms or complications caused by or associated with an allergen or to be provided specific immunotherapy can be administered a protein, peptide, subsequence, portion, homologue, variant or derivative thereof. In another non-limiting example, a subject that is not specifically at risk of exposure to or contact by an allergen, but nevertheless desires protection against an allergic response, allergic disorder or allergic disease, or one or more physiological conditions, disorders, illnesses, diseases, symptoms or complications caused by or associated with an allergen, can be administered a protein, peptide, subsequence, portion, homologue, variant or derivative thereof. Such subjects are also considered in need of treatment.

"Prophylaxis" and grammatical variations thereof mean a method or use in which contact, administration or in vivo delivery to a subject is prior to contact with or exposure to an allergen. In certain situations it may not be known that a subject has been contacted with or exposed to an allergen, but administration or in vivo delivery to a subject can be performed prior to manifestation of an allergic response, allergic disorder or allergic disease, or one or more physiological conditions, disorders, illnesses, diseases, symptoms or complications caused by or associated with an allergen. For example, a subject can be provided protection against an allergic response, allergic disorder or allergic disease, or one or more physiological conditions, disorders, illnesses, diseases, symptoms or complications caused by or associated with an allergen or provided specific immunotherapy with a protein, peptide, subsequence, portion, homologue, variant or derivative thereof. In such case, a method or use can eliminate, prevent, inhibit, suppress, limit, decrease or reduce the probability of or susceptibility towards an allergic response, allergic disorder or allergic disease, or one or more physiological conditions, disorders, illnesses, diseases, symptoms or complications caused by or associated with an antigen/allergen.

"Prophylaxis" can also refer to a method or use in which contact, administration or in vivo delivery to a subject is prior to a secondary or subsequent exposure to an antigen/allergen. In such a situation, a subject may have had a prior contact or exposure to an allergen. In such subjects, an acute allergic reaction may but need not be resolved. Such a subject typically may have developed anti-allergen antibodies due to the prior exposure. Immunization or vaccination, by administration or in vivo delivery to such a subject, can be performed prior to a secondary or subsequent allergen exposure. Such a method or use can eliminate, prevent, inhibit, suppress, limit, decrease or reduce the probability of or susceptibility towards a secondary or subsequent allergic response, allergic disorder or allergic disease, or one or more physiological conditions, disorders, illnesses, diseases, symptoms or complications caused by or associated with an allergen. In certain embodiments, such a method or use includes providing specific immunotherapy to the subject to eliminate, prevent, inhibit, suppress, limit, decrease or reduce the probability of or susceptibility towards a secondary or subsequent allergic response, allergic disorder or allergic disease, or one or more physiological conditions, disorders, illnesses, diseases, symptoms or complications caused by or associated with an antigen/allergen.

Treatment of an allergic reaction or response can be at any time during the reaction or response. A protein, peptide, subsequence, portion, homologue, variant or derivative thereof, can be administered as a combination (e.g., with a second active), or separately concurrently or in sequence (sequentially) in accordance with the methods and uses described herein as a single or multiple dose e.g., one or more times hourly, daily, weekly, monthly or annually or between about 1 to 10 weeks, or for as long as appropriate, for example, to achieve a reduction in the onset, progression, severity, frequency, duration of one or more symptoms or complications associated with or caused by an allergic response, allergic disorder or allergic disease, or one or more physiological conditions, disorders, illnesses, diseases, symptoms or complications caused by or associated with an antigen/allergen.

Accordingly, methods and uses of the invention can be practiced one or more times (e.g., 1-10, 1-5 or 1-3 times) an hour, day, week, month, or year. The skilled artisan will know when it is appropriate to delay or discontinue administration. A non-limiting dosage schedule is 1-7 times per week, for 1, 2, 3, 4, 5, 6, 7, 8, 9, 10, 15, 20 or more weeks.

Doses can be based upon current existing protocols, empirically determined, using animal disease models or optionally in human clinical trials. Initial study doses can be based upon animal studies, e.g. a mouse, and the amount of protein, peptide, subsequence, portion, homologue, variant or derivative thereof, administered that is determined to be effective. Exemplary non-limiting amounts (doses) are in a range of about 0.1 mg/kg to about 100 mg/kg, and any numerical value or range or value within such ranges. Greater or lesser amounts (doses) can be administered, for example, 0.01-500 mg/kg, and any numerical value or range or value within such ranges. The dose can be adjusted according to the mass of a subject, and will generally be in a range from about 1-10 ug/kg, 10-25 ug/kg, 25-50 ug/kg, 50-100 ug/kg, 100-500 ug/kg, 500-1,000 ug/kg, 1-5 mg/kg, 5-10 mg/kg, 10-20 mg/kg, 20-50 mg/kg, 50-100 mg/kg, 100-250 mg/kg, 250-500 mg/kg, or more, two, three, four, or more times per hour, day, week, month or annually. A typical range will be from about 0.3 mg/kg to about 50 mg/kg, 0-25 mg/kg, or 1.0-10 mg/kg, or any numerical value or range or value within such ranges.

Doses can vary and depend upon whether the treatment is prophylactic or therapeutic, whether a subject has been previously exposed to the antigen/allergen, the onset, progression, severity, frequency, duration, probability of or susceptibility of the symptom, condition, pathology or complication, or vaccination or specific immunotherapy to which treatment is directed, the clinical endpoint desired, previous or simultaneous treatments, the general health, age, gender, race or immunological competency of the subject and other factors that will be appreciated by the skilled artisan. The skilled artisan will appreciate the factors that may influence the dosage and timing required to provide an amount sufficient for providing a therapeutic or prophylactic benefit.

Typically, for treatment, a protein, peptide, subsequence, portion, homologue, variant or derivative thereof, will be administered as soon as practical, typically within 1-2, 2-4, 4-12, 12-24 or 24-72 hours after a subject is exposed to or contacted with an allergen, or within 1-2, 2-4, 4-12, 12-24 or 24-48 hours after onset or development of one or more of an allergic response, allergic disorder or allergic disease, or one or more physiological conditions, disorders, illnesses, diseases, symptoms or complications caused by or associated with an antigen/allergen.

For prophylactic treatment in connection with vaccination or specific immunotherapy, proteins, peptides, subsequences, portions, homologues, variants or derivatives thereof, can be administered for a duration of 0-4 weeks, e.g., 2-3 weeks, prior to exposure to or contact by an allergen or at least within 1-2, 2-4, 4-12, 12-24, 24-48 or 48-72 hours prior to exposure to or contact by an allergen. For an acute allergic reaction, proteins, peptides, subsequences, portions, homologues, variants or derivatives thereof may be administered at any appropriate time.

The dose amount, number, frequency or duration may be proportionally increased or reduced, as indicated by the status of the subject. For example, whether the subject has an allergic response, whether the subject has been exposed to or contacted by an allergen or is merely at risk of allergen contact or exposure, whether the subject is a candidate for or will be vaccinated or provided specific immunotherapy. The dose amount, number, frequency or duration may be proportionally increased or reduced, as indicated by any adverse side effects, complications or other risk factors of the treatment or therapy.

In methods and uses and medicaments of the invention, the route, dose, number and frequency of administrations, treatments, vaccinations and specific immunotherapy, and timing/intervals between treatment, vaccination and specific immunotherapy, and allergen exposure can be modified. Although rapid induction of immune responses or immunological tolerance is desired for developing protective emergency vaccines against an allergic response, allergic disorder or allergic disease, or one or more physiological conditions, disorders, illnesses, diseases, symptoms or complications caused by or associated with an allergen, in certain embodiments, a desirable treatment will elicit robust, long-lasting protection against an allergic response, allergic disorder or allergic disease, or one or more physiological conditions, disorders, illnesses, diseases, symptoms or complications caused by or associated with an allergen. Thus, in certain embodiments, invention compositions, methods and uses and medicaments provide long-lasting protection against an allergic response, allergic disorder or allergic disease, or one or more physiological conditions, disorders, illnesses, diseases, symptoms or complications caused by or associated with an allergen. Specific immunotherapy strategies can provide long-lived protection against an allergic response, allergic disorder or allergic disease, or one or more physiological conditions, disorders, illnesses, diseases, symptoms or complications caused by or associated with an allergen depending on the level of induced immunological tolerance or a T cell response or activity.

Cockroach proteins or peptides, or subsequences, portions, homologues, variants or derivatives thereof can be provided in compositions, and in turn can be used in accordance with the invention methods and uses and medicaments. Such compositions, methods and uses and medicaments include pharmaceutical compositions and formulations. In certain embodiments, a pharmaceutical composition includes one or more Cockroach proteins, peptides, subsequences, portions, homologues, variants or derivatives thereof described herein (e.g., an amino acid sequence of a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8). In particular, aspects, such compositions and formulations may be a vaccine, including but not limited to a vaccine to protect against an allergic response, allergic disorder or allergic disease, or one or more physiological conditions, disorders, illnesses, diseases, symptoms or complications caused by or associated with an allergen (e.g., a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16).

As used herein the term "pharmaceutically acceptable" and "physiologically acceptable" mean a biologically acceptable formulation, gaseous, liquid or solid, or mixture thereof, which is suitable for one or more routes of administration, in vivo delivery or contact. Such formulations include solvents (aqueous or non-aqueous), solutions (aqueous or non-aqueous), emulsions (e.g., oil-in-water or water-in-oil), suspensions, syrups, elixirs, dispersion and suspension media, coatings, isotonic and absorption promoting or delaying agents, compatible with pharmaceutical administration or in vivo contact or delivery. Aqueous and non-aqueous solvents, solutions and suspensions may include suspending agents and thickening agents. Such pharmaceutically acceptable carriers include tablets (coated or uncoated), capsules (hard or soft), microbeads, powder, granules and crystals. Supplementary active compounds (e.g., preservatives, antibacterial, antiviral and antifungal agents) can also be incorporated into the compositions.

To increase an immune response, immunological tolerance or protection against an allergic response, allergic disorder or allergic disease, or one or more physiological conditions, disorders, illnesses, diseases, symptoms or complications caused by or associated with an allergen, proteins, peptides, subsequences, portions, homologues, variants or derivatives thereof, can be coupled to another protein such as ovalbumin or keyhole limpet hemocyanin (KLH), thyroglobulin or a toxin such as tetanus or cholera toxin. Proteins, peptides, subsequences, portions, homologues, variants or derivatives thereof can also be mixed with adjuvants.

Adjuvants include, for example: oil (mineral or organic) emulsion adjuvants such as Freund's complete (CFA) and incomplete adjuvant (IFA) (WO 95/17210; WO 98/56414; WO 99/12565; WO 99/11241; and U.S. Pat. No. 5,422,109); metal and metallic salts, such as aluminum and aluminum salts, such as aluminum phosphate or aluminum hydroxide, alum (hydrated potassium aluminum sulfate); bacterially derived compounds, such as Monophosphoryl lipid A and derivatives thereof (e.g., 3 De-O-acylated monophosphoryl lipid A, aka 3D-MPL or d3-MPL, to indicate that position 3 of the reducing end glucosamine is de-O-acylated, 3D-MPL consisting of the tri and tetra acyl congeners), and enterobacterial lipopolysaccharides (LPS); plant derived saponins and derivatives thereof, for example Quil A (isolated from the Quilaja *Saponaria* Molina tree, see, e.g., "Saponin adjuvants", Archiv. fur die gesamte Virusforschung, Vol. 44, Springer Verlag, Berlin, p 243-254; U.S. Pat. No. 5,057, 540), and fragments of Quil A which retain adjuvant activity without associated toxicity, for example QS7 and QS21 (also known as QA7 and QA21), as described in WO96/33739, for example; surfactants such as, soya lecithin and oleic acid; sorbitan esters such as sorbitan trioleate; and polyvinylpyrrolidone; oligonucleotides such as CpG (WO 96/02555, and WO 98/16247), polyriboA and polyriboU; block copolymers; and immunostimulatory cytokines such as GM-CSF and IL-1, and Muramyl tripeptide (MTP). Additional examples of adjuvants are described, for example, in "Vaccine Design—the subunit and adjuvant approach" (Edited by Powell, M. F. and Newman, M. J.; 1995, Pharmaceutical Biotechnology (Plenum Press, New York and London, ISBN 0-306-44867-X) entitled "Compendium of vaccine adjuvants and excipients" by Powell, M. F. and Newman M.

Cosolvents may be added to a protein, peptide, subsequence, portion, homologue, variant or derivative thereof, composition or formulation. Non-limiting examples of cosolvents contain hydroxyl groups or other polar groups, for example, alcohols, such as isopropyl alcohol; glycols, such as propylene glycol, polyethyleneglycol, polypropylene glycol, glycol ether; glycerol; polyoxyethylene alcohols and polyoxyethylene fatty acid esters. Non-limiting examples of cosolvents contain hydroxyl groups or other polar groups, for example, alcohols, such as isopropyl alcohol; glycols, such as propylene glycol, polyethyleneglycol, polypropylene glycol, glycol ether; glycerol; polyoxyethylene alcohols and polyoxyethylene fatty acid esters.

Supplementary compounds (e.g., preservatives, antioxidants, antimicrobial agents including biocides and biostats such as antibacterial, antiviral and antifungal agents) can also be incorporated into the compositions. Pharmaceutical compositions may therefore include preservatives, anti-oxidants and antimicrobial agents.

Preservatives can be used to inhibit microbial growth or increase stability of ingredients thereby prolonging the shelf life of the pharmaceutical formulation. Suitable preservatives are known in the art and include, for example, EDTA, EGTA, benzalkonium chloride or benzoic acid or benzoates, such as sodium benzoate. Antioxidants include, for example, ascorbic acid, vitamin A, vitamin E, tocopherols, and similar vitamins or provitamins.

An antimicrobial agent or compound directly or indirectly inhibits, reduces, delays, halts, eliminates, arrests, suppresses or prevents contamination by or growth, infectivity, replication, proliferation, reproduction, of a pathogenic or non-pathogenic microbial organism. Classes of antimicrobials include antibacterial, antiviral, antifungal and antiparasitics. Antimicrobials include agents and compounds that kill or destroy (-cidal) or inhibit (-static) contamination by or growth, infectivity, replication, proliferation, reproduction of the microbial organism.

Exemplary antibacterials (antibiotics) include penicillins (e.g., penicillin G, ampicillin, methicillin, oxacillin, and amoxicillin), cephalosporins (e.g., cefadroxil, ceforanid, cefotaxime, and ceftriaxone), tetracyclines (e.g., doxycycline, chlortetracycline, minocycline, and tetracycline), aminoglycosides (e.g., amikacin, gentamycin, kanamycin, neomycin, streptomycin, netilmicin, paromomycin and tobramycin), macrolides (e.g., azithromycin, clarithromycin, and erythromycin), fluoroquinolones (e.g., ciprofloxacin, lomefloxacin, and norfloxacin), and other antibiotics including chloramphenicol, clindamycin, cycloserine, isoniazid, rifampin, vancomycin, aztreonam, clavulanic acid, imipenem, polymyxin, bacitracin, amphotericin and nystatin.

Particular non-limiting classes of anti-virals include reverse transcriptase inhibitors; protease inhibitors; thymidine kinase inhibitors; sugar or glycoprotein synthesis inhibitors; structural protein synthesis inhibitors; nucleoside analogues; and viral maturation inhibitors. Specific non-limiting examples of anti-virals include nevirapine, delavirdine, efavirenz, saquinavir, ritonavir, indinavir, nelfinavir, amprenavir, zidovudine (AZT), stavudine (d4T), larnivudine (3TC), didanosine (DDI), zalcitabine (ddC), abacavir, acyclovir, penciclovir, ribavirin, valacyclovir, ganciclovir, 1,-D-ribofuranosyl-1,2,4-triazole-3 carboxamide, 9→2-hydroxyethoxy methylguanine, adamantanamine, 5-iodo-2'-deoxyuridine, trifluorothymidine, interferon and adenine arabinoside.

Pharmaceutical formulations and delivery systems appropriate for the compositions, methods and uses and medicaments of the invention are known in the art (see, e.g., *Remington: The Science and Practice of Pharmacy* (2003) 20$^{th}$ ed., Mack Publishing Co., Easton, Pa.; *Remington's Pharmaceutical Sciences* (1990) 18$^{th}$ ed., Mack Publishing Co., Easton, Pa.; *The Merck Index* (1996) 12$^{th}$ ed., Merck Publishing Group, Whitehouse, N.J.; *Pharmaceutical Principles of Solid Dosage Forms* (1993), Technonic Publishing Co., Inc., Lancaster, Pa.; Ansel ad Soklosa, *Pharmaceutical Calculations* (2001) 11$^{th}$ ed., Lippincott Williams & Wilkins, Baltimore, Md.; and Poznansky et al., *Drug Delivery Systems* (1980), R. L. Juliano, ed., Oxford, N.Y., pp. 253-315).

Pharmaceutical compositions can be formulated to be compatible with a particular route of administration. Thus, pharmaceutical compositions include carriers, diluents, or excipients suitable for administration by various routes. Exemplary routes of administration for contact or in vivo delivery which a composition can optionally be formulated include inhalation, respiration, intranasal, intubation, intrapulmonary instillation, oral, buccal, intrapulmonary, intradermal, topical, dermal, parenteral, sublingual, subcutaneous, intravascular, intrathecal, intraarticular, intracavity, transdermal, iontophoretic, intraocular, opthalmic, optical, intravenous (i.v.), intramuscular, intraglandular, intraorgan, or intralymphatic.

Formulations suitable for parenteral administration include aqueous and non-aqueous solutions, suspensions or emulsions of the active compound, which preparations are typically sterile and can be isotonic with the blood of the intended recipient. Non-limiting illustrative examples include water, saline, dextrose, fructose, ethanol, animal, vegetable or synthetic oils.

Methods and uses of the invention may be practiced by any mode of administration or delivery, or by any route, systemic, regional and local administration or delivery. Exemplary administration and delivery routes include intravenous (i.v.), intraperitoneal (i.p.), intrarterial, intramuscular, parenteral, subcutaneous, intra-pleural, topical, dermal, intradermal, transdermal, transmucosal, intra-cranial, intraspinal, rectal, oral (alimentary), mucosal, inhalation, respiration, intranasal, intubation, intrapulmonary, intrapulmonary instillation, buccal, sublingual, intravascular, intrathecal, intracavity, iontophoretic, intraocular, ophthalmic, optical, intraglandular, intraorgan, or intralymphatic.

For oral administration, a composition can take the form of, for example, tablets or capsules prepared by conventional means with pharmaceutically acceptable excipients such as binding agents (for example, pregelatinised maize starch, polyvinylpyrrolidone or hydroxypropyl methylcellulose); fillers (for example, lactose, microcrystalline cellulose or calcium hydrogen phosphate); lubricants (for example, magnesium stearate, talc or silica); disintegrants (for example, potato starch or sodium starch glycolate); or wetting agents (for example, sodium lauryl sulphate). The tablets can be coated by methods known in the art. Liquid preparations for oral administration can take the form of, for example, solutions, syrups or suspensions, or they can be presented as a dry product for constitution with water or other suitable vehicle before use. Such liquid preparations can be prepared by conventional means with pharmaceutically acceptable additives such as suspending agents (for example, sorbitol syrup, cellulose derivatives or hydrogenated edible fats); emulsifying agents (for example, lecithin or acacia); non-aqueous vehicles (for example, almond oil, oily esters, ethyl alcohol or fractionated vegetable oils); and preservatives (for example, methyl or propyl-p-hydroxybenzoates or sorbic acid). The preparations can also contain buffer salts, flavoring, coloring, and sweetening agents as appropriate.

For administration by inhalation, a composition can be delivered in the form of an aerosol spray presentation from pressurized packs or a nebulizer, with the use of a suitable propellant, for example, dichlorodifluoromethane, trichlorofluoromethane, dichlorotetrafluoroethane, carbon dioxide or other suitable gas. In the case of a pressurized aerosol, the dosage unit can be determined by providing a valve to deliver a metered amount. Capsules and cartridges for use in an inhaler or insufflator can be formulated containing a powder mix of the compound and a suitable powder base such as lactose or starch.

Invention Cockroach proteins and peptides, e.g., a protein or peptide set forth in any of Tables 5-8, subsequences, portions, homologues, variants or derivatives thereof optionally along with any adjunct agent, compound, drug, composition, whether active or inactive, etc., can be packaged in unit dosage form (capsules, tablets, troches, cachets, lozenges) for ease of administration and uniformity of dosage. A "unit dosage form" as used herein refers to physically discrete units suited as unitary dosages for the subject to be treated; each unit containing a predetermined quantity of active ingredient optionally in association with a pharmaceutical carrier (excipient, diluent, vehicle or filling agent) which, when administered in one or more doses, is calculated to produce a desired effect (e.g., prophylactic or therapeutic effect). Unit dosage forms also include, for example, ampules and vials, which may include a composition in a freeze-dried or lyophilized state; a sterile liquid carrier, for example, can be added prior to administration or delivery in vivo. Unit dosage forms additionally include, for example, ampules and vials with liquid compositions disposed therein. Individual unit dosage forms can be included in multi-dose kits or containers. Pharmaceutical formulations can be packaged in single or multiple unit dosage form for ease of administration and uniformity of dosage.

The invention also provides methods of diagnosing and detecting an allergic response or allergy in a subject. The methods can be performed in solution, in solid phase, in silica, in vitro, in a cell, and in vivo. In one embodiment, a method includes contacting a cell (e.g., T cell) from the subject with a Cockroach protein, peptide, subsequence, portion, homologue, variant or derivative thereof, as described herein (e.g., of an amino acid sequence of a Cockroach allergen such as a protein or of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8; and determining if the protein or peptide modulates an immune response or activity of the contacted cell (e.g., T cell). A determination that the Cockroach protein or peptide modulates an immune response or immune activity of the contacted cell indicates that the subject has an allergic response or an allergy, in particular, an allergy to the protein, peptide, subsequence, portion, homologue, variant or derivative thereof (e.g., of a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8). In a particular aspect, the immune activity determined is Th2 cell reactivity. In another particular aspect, immune response or activity is determined by assaying for a cutaneous immunological hypersensitive reaction.

The invention also provides methods of diagnosing and detecting allergic rhinitis or asthma in a subject. The methods can be performed in solution, in solid phase, in silica, in vitro, in a cell, and in vivo.

In one embodiment, a method of diagnosing asthma in a subject includes contacting a cell (e.g., T cell) from the subject with one or more Cockroach proteins or peptides with an amino acid sequence comprising, consisting of or consisting essentially an amino acid sequence of any of (SEQ ID NOs.: 46-203): NAIEFLNNIHDLLGI (SEQ ID NO: 46), IDDIIAILPVDDLYA (SEQ ID NO: 47), LIPVDQIIAIATDYL (SEQ ID NO: 48), QIIAIATDYLANDAE (SEQ ID NO: 49), ATDYLANDAEVQAAV (SEQ ID NO: 50), EYQNLIQKLKDKGVD (SEQ ID NO: 51), IQKLKDKGVDVDHII (SEQ ID NO: 52), DKGVDVDHIIELIHQ (SEQ ID NO: 53), DTRGLPEDLQDFLAL (SEQ ID NO: 54), LIPTDQVLAIAADYL (SEQ ID NO: 55), QVLAIAADYLANDAE (SEQ ID NO: 56), LKALFNEKLETSPDF (SEQ ID NO: 57), EYLKSDEFETIVVTV (SEQ ID NO: 58), DEFETIVVTVDSLPE (SEQ ID NO: 59), IVVTVDSLPEFKNFL (SEQ ID NO: 60), DDLQDFLALIPVDQI (SEQ ID NO: 61), PVDQIIAIATDYLAN (SEQ ID NO: 62), IAIATDYLANDAEVQ (SEQ ID NO: 63), DYLANDAEVQAAVAY (SEQ ID NO: 64), DAEVQAAVAYLQSDE (SEQ ID NO: 65), AAVAYLQSDEFETIV (SEQ ID NO: 66), VTLDALPELQNFLNF (SEQ ID NO: 67), LPELQNFLNFLEANG (SEQ ID NO: 68), HDLLGIPHIPVSGRK (SEQ ID NO: 69), IPHIPVSGRKYHIRR (SEQ ID NO: 70), VSGRKYHIRRGVGIT (SEQ ID NO: 71), PIDQILAIAADYLAN (SEQ ID NO: 72), DYLANDAEVQAAVEY (SEQ ID NO: 73), VTVDSLPEFKNFLNF (SEQ ID NO: 74), LQTNGLNAIEFINNI (SEQ ID NO: 75), LNAIEFINNIHDLLG (SEQ ID NO: 76), ATGRKHVRRGVGING (SEQ ID NO: 77), HVRRGVGINGLIDDV (SEQ ID NO: 78), VGINGLIDDVIAILP (SEQ ID NO: 79), IAILPVDELYALFQE (SEQ ID NO: 80), KLESSPEFKALYDAI (SEQ ID NO: 81), PEFKALYDAIRSPEF (SEQ ID NO: 82), LYDAIRSPEFQSIVQ (SEQ ID NO: 83), RSPEFQSIVQTLKAM (SEQ ID NO: 84), QSIVQTLKAMPEYQD (SEQ ID NO: 85), TLKAMPEYQDLIQRL (SEQ ID NO: 86), IHENLIVTSPFRPWW (SEQ ID NO: 87), FRPWWERYQLVSYNL (SEQ ID NO: 88), ERYQLVSYNLNSRSG (SEQ ID NO: 89), RCNNVGIRIYVDVVL (SEQ ID NO: 90), GIRIYVDVVLNQMSG (SEQ ID NO: 91), RGNNAIKWLVNFGVG (SEQ ID NO: 92), GASILTYKTSKLYKM (SEQ ID NO: 93), KLYKMAVAFMLAYPY (SEQ ID NO: 94), WVCEHRWRQIFNMVG (SEQ ID NO: 95), RWRQIFNMVGFRNAV (SEQ ID NO: 96), LTVFDSTSCNVVVAS (SEQ ID NO: 97), STSCNVVVASQECVG (SEQ ID NO: 98), GRGIEDSLTISNLTT (SEQ ID NO: 99), SQQDIVLADELSQEV (SEQ ID NO: 100), AVLALCATDTLANED (SEQ ID NO: 101), CATDTLANEDCFRHE (SEQ ID NO: 102), LANEDCFRHESLVPN (SEQ ID NO: 103), PYSVLATDYENYAIV (SEQ ID NO: 104), VNQHKKAIEEDLKHF (SEQ ID NO: 105), KHFNLKYEDLHSTCH (SEQ ID NO: 106), MAPSYKLTYCPVKAL (SEQ ID NO: 107), KLTYCPVKALGEPIR (SEQ ID NO: 108), FLLSYGEKDFEDYRF (SEQ ID NO: 109), GEKDFEDYRFQEGDW (SEQ ID NO: 110), PNLKPSMPFGKTPVL (SEQ ID NO: 111), QTHQSVAISRYLGKQ (SEQ ID NO: 112), VAISRYLGKQFGLSG (SEQ ID NO: 113), YLGKQFGLSGKDDWE (SEQ ID NO: 114), KDDWENLEIDMIVDT (SEQ ID NO: 115), NLEIDMIVDTISDFR (SEQ ID NO: 116), MIVDTISDFRAAIAN (SEQ ID NO: 117), ISDFRAAIANYHYDA (SEQ ID NO: 118), AAIANYHYDADENSK (SEQ ID NO: 119), YHYDADENSKQKKWD (SEQ ID NO: 120), EVVKANGGYLAAGKL (SEQ ID NO: 121), NGGYLAAGKLTWADF (SEQ ID NO: 122), AAGKLTWADFYFVAI (SEQ ID NO: 123), HMAKEDLVANQPNLK (SEQ ID NO: 124), DLVANQPNLKALREK (SEQ ID NO: 125), AAKFIIEEDSEAMEK (SEQ ID NO: 126), IEEDSEAMEKELREA (SEQ ID NO: 127), EAMEKELREAFRLYD (SEQ ID NO: 128), ELREAFRLYDKEGNG (SEQ ID NO: 129), FRLYDKEGNGYIPTS (SEQ ID NO: 130), KEGNGYIPTSCLREI (SEQ ID NO: 131), YIPTSCLREILRELD (SEQ ID NO: 132), DELDMMIEEIDADGS (SEQ ID NO: 133), KALQNAESEVAALNR (SEQ ID NO: 134), RSEERLATATAKLAE (SEQ ID NO: 135), VQKLQKEVDRLEDEL (SEQ ID NO: 136), KEVDRLEDELVHEKE (SEQ ID NO: 137), EAGFAKLAASDSKSL (SEQ ID NO: 138), KLAASDSKSLLRKYL (SEQ ID NO: 139), RCGRSMQGYPFNPCL (SEQ ID NO: 140), LIDDHFLFKEGDRFL (SEQ ID NO: 141), FLFKEGDRFLQHANA (SEQ ID NO: 142), WCNEEDHLRIISMQM (SEQ ID NO: 143), QVYRRLVTAVNDIEK (SEQ ID NO: 144), RVPFSHDDRLGFLTF (SEQ ID NO: 145), HDDRLGFLTFCPTNL (SEQ ID NO: 146), CPTNLGTTVRASVRI (SEQ ID NO: 147), SPYFVTNTEKMITEF (SEQ ID NO: 148), KIGEYKNMIAEGIID (SEQ ID NO: 149), RHNSAYKLHFNAFEY (SEQ ID NO: 150), STSLVKAHSMRNSAS (SEQ ID NO: 151), AVRLSKDIAADLQGE (SEQ ID NO: 152), LVRLLKQLKVSQIME (SEQ ID NO: 153), KQLKVSQIMEAARKL (SEQ ID NO: 154), QQFISSEMVEPKEAS (SEQ ID NO: 155), KNMTYVNTSLVLAFS (SEQ ID NO: 156), QKGYMVSSMTDLWEA (SEQ ID NO: 157), NTTFSNASAVIQEFL (SEQ ID NO: 158), PAYFKMNSPSLWKYN (SEQ ID NO: 159), MNITGSINLMFSQMY (SEQ ID NO: 160), SINLMFSQMYHAQLA (SEQ ID NO: 161), FSQMYHAQLAFSTAF (SEQ ID NO: 162), FQINLDFKNHNGFIR (SEQ ID NO: 163), DVLQWQTIPYTTIHN (SEQ ID NO: 164), VPIMNIYSAFEFDPN (SEQ ID NO: 165), LRLSEHLDYVKNLTV (SEQ ID NO: 166), AKRFAKWALPLYNKP (SEQ ID NO: 167), HIVFPSYEIEMFYDG (SEQ ID NO: 168), SYEIEMFYDGSRIMI (SEQ ID NO: 169), RILLRLHRCFQVLGR (SEQ ID NO: 170), IRHAILAAGDLYSRR (SEQ ID NO: 171), QSYETKLLFDLFYYA (SEQ ID NO: 172), KLLFDLFYYANDYDT (SEQ ID NO: 173), HINEGQFLYALSSAL (SEQ ID NO: 174), QFLYALSSALFQRED (SEQ ID NO: 175), LNDYILPAPYEIYPW (SEQ ID NO: 176), EIYPWLFVDSDVIQR (SEQ ID NO: 177), LNTYYSYYYFNYPTF (SEQ ID NO: 178), SYYYFNYPTFFNSTE (SEQ ID NO: 179), DRRGEMFYYTRQQLY (SEQ ID NO: 180), MFYYTRQQLYARYFL (SEQ ID NO: 181), RQQLYARYFLERLSN (SEQ ID NO: 182), ARYFLERLSNDLPDV (SEQ ID NO: 183), QATDAYVRVFLGPKY (SEQ ID NO: 184), KELVEKYGKGKAIFI (SEQ ID NO: 185), EDAFKKAYNAFKSLD (SEQ ID NO: 186), AKGMMHMIKKGANGS (SEQ ID NO: 187), VYEVAIPDRLTLRVE (SEQ ID NO: 188), QTLFLLLLLLAAVSA (SEQ ID NO: 189), SLLLNGGCKVSNYDE (SEQ ID NO: 190), EVKIVATLKALQNAH (SEQ ID NO: 191), ISLEVLKNYQLDSEL (SEQ ID NO: 192), LKNYQLDSELRIKAF (SEQ ID NO: 193), QVGSFIVSYLRNLRA (SEQ ID NO: 194), THQFNVAGSVTVDKT (SEQ ID NO: 195), LNQEAHYQFDSIHKF (SEQ ID NO: 196), HYQFDSIHKFEFASK (SEQ ID NO: 197), KAAVHLLVAVKASKE (SEQ ID NO: 198), WVPSKKCHLTNIACL (SEQ ID NO: 199), KCHLTNIACLLHNKY (SEQ ID NO: 200), DVLDIGGLKVQKQTF (SEQ ID NO: 201), DRKMYWQFKMDKIQI (SEQ ID NO: 202) or GHSHFVSDVVLSSDG (SEQ ID NO: 203), or a subsequence, portion, homologue, variant or derivative thereof, as described herein, (e.g. peptides of the Asthmas Epitope Set in Table 8) and determining if the one or more proteins or peptides modulates an immune response or activity of the contacted cell (e.g., T cell). A determination that the one or more Cockroach proteins or peptides modulates an immune response or immune activity of the contacted cell indicates that the subject has asthma.

In another embodiment, a method of diagnosing allergic rhinitis in a subject includes contacting a cell (e.g., T cell) from the subject with one or more Cockroach proteins or peptides with an amino acid sequence comprising, consisting of or consisting essentially an amino acid sequence of any of (SEQ ID NOs.: 204-256): DCGVAGFRVDAAKHM (SEQ ID NO: 204), LDYERFRGSWIIAAG (SEQ ID NO: 205), KNRTTIRGRTKFEGN (SEQ ID NO: 206), IRGRTKFEGNKFTID (SEQ ID NO: 207), KFEGNKFTIDYNDKG (SEQ ID NO: 208), ATDYENYAIVEGCPA (SEQ ID NO: 209), NYAIVEGCPAAANGH (SEQ ID NO: 210), VIYVQIRFSVRRFHP (SEQ ID NO: 211), IRFSVRRFHPKLGDK (SEQ ID NO: 212), KLGDKEMIQHYTLDQ (SEQ ID NO: 213), KAIEEDLKHFNLKYE (SEQ ID NO: 214), KTPVLEIDGKQTHQS (SEQ ID NO: 215), DENSKQKKWDPLKKE (SEQ ID NO: 216), QKKWDPLKKETIPYY (SEQ ID NO: 217), PLKKETIPYYTKKFD (SEQ ID NO: 218), TIPYYTKKFDEVVKA (SEQ ID NO: 219), TKKFDEVVKANGGYL (SEQ ID NO: 220), YFVAILDYLNHMAKE (SEQ ID NO: 221), QPNLKALREKVLGLP (SEQ ID NO: 222), ALREKVLGLPAIKAW (SEQ ID NO: 223), VLGLPAIKAWVAKRP (SEQ ID NO: 224), VLEKLEAGFAKLAAS (SEQ ID NO: 225), FGSTLLDVIQSGLEN (SEQ ID NO: 226), NDIEKRVPFSHDDRL (SEQ ID NO: 227), ALNSIQQFISSEMVE (SEQ ID NO: 228), VEALFLLMKADPSIH (SEQ ID NO: 229), DPSIHVLKMVAELTH (SEQ ID NO: 230), PKSMLLNIFTNNLGR (SEQ ID NO: 231), LNIFTNNLGRINTHV (SEQ ID NO: 232), KTLVKFVEGNLKYFN (SEQ ID NO: 233), LKYFNMGVQKFWAFD (SEQ ID NO: 234), MGVQKFWAFDNTTFS (SEQ ID NO: 235), NASAVIQEFLKTYKK (SEQ ID NO: 236), HTKLSSSSSITLTLP (SEQ ID NO: 237), SVNATVVRLQSWQSE (SEQ ID NO: 238), VVRLQSWQSEMLRMN (SEQ ID NO: 239), PRHGEQFYYFYQQIY (SEQ ID NO: 240), DYQSYRTLMRKVYDA (SEQ ID NO: 241), GQEYTFYVIVTPYAK (SEQ ID NO: 242), KAIFIKCDVTNIPEF (SEQ ID NO: 243), IVINNAGILNDEKWE (SEQ ID NO: 244), KEFANVVRVVRHTSK (SEQ ID NO: 245), RIKAFLALVECPCNK (SEQ ID NO: 246), FRKFSNNFEFSYLLG (SEQ ID NO: 247), NVIYSQNSFLPRATT (SEQ ID NO: 248), RLFGAEVGWLALHHN (SEQ ID NO: 249), LVYPTSLGFPLKLVL (SEQ ID NO: 250), SHVHFRFVPSAAVEF (SEQ ID NO: 251), KKLQFTYSESLDLDD (SEQ ID NO: 252), AQIQVVIHLDEQYIY (SEQ ID NO: 253), GVTPVFYNMVKQGLV (SEQ ID NO: 254), SEVTALNRQIGGTPI (SEQ ID NO: 255), or GKDYILRVSQLGHTV (SEQ ID NO: 256), or a subsequence, portion, homologue, variant or derivative thereof, as described herein, (e.g. peptides of the AR Epitope Set in Table 8) and determining if the one or more proteins or peptides modulates an immune response or activity of the contacted cell (e.g., T cell). A determination that the one or more Cockroach proteins or peptides modulates an immune response or immune activity of the contacted cell indicates that the subject has allergic rhinitis.

The terms "determining," "assaying" and "measuring" and grammatical variations thereof are used interchangeably herein and refer to either qualitative or quantitative determinations, or both qualitative and quantitative determinations, that involve manipulation or processing. When the terms are used in reference to measurement or detection, any means of assessing the relative amount, including the various methods set forth herein and known in the art, performed by the hand of man, is contemplated.

The invention provides kits including Cockroach protein, peptide, subsequence, portion, homologue, variant or derivative thereof (e.g., of an amino acid sequence of a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8), combination compositions and pharmaceutical formulations thereof, packaged into suitable packaging material. Kits can be used in various in vitro, ex vivo and in vivo methods and uses, for example a treatment method or use as disclosed herein.

A kit typically includes a label or packaging insert including a description of the components or instructions for use in vitro, in vivo, or ex vivo, of the components therein. A kit can contain a collection of such components, e.g., a Cockroach protein, peptide, subsequence, portion, homologue, variant or derivative thereof (e.g., of an amino acid sequence of a Cockroach protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8, alone, or in combination with another therapeutically useful composition (e.g., an immune modulatory drug).

The term "packaging material" refers to a physical structure housing the components of the kit. The packaging material can maintain the components sterilely, and can be made of material commonly used for such purposes (e.g., paper, corrugated fiber, glass, plastic, foil, ampules, vials, tubes, etc.).

Kits of the invention can include labels or inserts. Labels or inserts include "printed matter," e.g., paper or cardboard, or separate or affixed to a component, a kit or packing material (e.g., a box), or attached to an ampule, tube or vial containing a kit component. Labels or inserts can additionally include a computer readable medium, such as a disk (e.g., hard disk), optical disk such as CD- or DVD-ROM/RAM, DVD, MP3, magnetic tape, or an electrical storage media such as RAM and ROM or hybrids of these such as magnetic/optical storage media, FLASH media or memory type cards.

Labels or inserts can include identifying information of one or more components therein, dose amounts, clinical pharmacology of the active ingredient(s) including mechanism of action, pharmacokinetics and pharmacodynamics. Labels or inserts can include information identifying manufacturer information, lot numbers, manufacturer location and date.

Labels or inserts can include information on a condition, disorder, disease or symptom for which a kit component may be used. Labels or inserts can include instructions for the clinician or for a subject for using one or more of the kit components in a method, use, treatment protocol or therapeutic regimen. Instructions can include dosage amounts, frequency or duration, and instructions for practicing any of the methods and uses, treatment protocols or therapeutic regimes set forth herein. Exemplary instructions include, instructions for modulating an immune response or activity of a cell against an allergen; modulating an immune response against an allergen in a subject; desensitizing, or inducing, eliciting, increasing or improving immunological tolerance to a protein or peptide allergen; reducing risk or providing a subject protection against an allergic reaction, allergic response, allergic disorder or allergic disease; treating an allergic reaction, allergic response, allergic disorder or allergic disease; or detecting an allergic response or diagnosing an allergy in a subject (e.g., a Cockroach allergy such as to a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16).

Labels or inserts can include information on any benefit that a component may provide, such as a prophylactic or therapeutic benefit. Labels or inserts can include information on potential adverse side effects, such as warnings to the subject or clinician regarding situations where it would not be appropriate to use a particular composition. Adverse side effects could also occur when the subject has, will be or is currently taking one or more other medications that may be incompatible with the composition, or the subject has, will be or is currently undergoing another treatment protocol or therapeutic regimen which would be incompatible with the composition and, therefore, instructions could include information regarding such incompatibilities.

Invention kits can additionally include other components. Each component of the kit can be enclosed within an individual container and all of the various containers can be within a single package. Invention kits can be designed for cold storage. Invention kits can further be designed to contain to the protein, peptide, subsequence, portion, homologue, variant or derivative thereof (e.g., of a Cockroach allergen such as a protein or peptide of Cockroach enolase, Hsp60, RACK1, TP1, trypsin, vitellogenin, Bla g 1, Bla g 1.0101, Bla g 2, Bla g 4, Bla g 5, Bla g 6, Bla g 6.0101, Bla g 6.0201, Bla g 7, Bla g 9, Bla g 11, NBGA1, NBGA2, NBGA3, NBGA4, NBGA5, NBGA6, NBGA7, NBGA8, NBGA9, NBGA10, NBGA11, NBGA12, NBGA13, NBGA14, NBGA15, or NBGA16, or a Cockroach protein or peptide set forth in any of Tables 5-8), or combination compositions or pharmaceutical compositions.

Unless otherwise defined, all technical and scientific terms used herein have the same meaning as commonly understood by one of ordinary skill in the art to which this invention belongs. Although methods and materials similar or equivalent to those described herein can be used in the practice or testing of the invention, suitable methods and materials are described herein.

All publications and patent applications cited in this specification are herein incorporated by reference as if each individual publication or patent application were specifically and individually indicated to be incorporated by reference. The citation of any publication is for its disclosure prior to the filing date and should not be construed as an admission that the invention is not entitled to antedate such publication by virtue of prior invention.

As used in this specification and the appended claims, the use of an indefinite article or the singular forms "a," "an" and "the" include plural reference unless the context clearly dictates otherwise. In addition, it should be understood that the individual peptides, proteins, antigens, allergens (referred to collectively as compositions), or groups of compositions, modeled or derived from the various components or combinations of the compositions, and substituents described herein, are disclosed by the application to the same extent as if each composition or group of compositions was set forth individually. Thus, selection of particular peptides, proteins, antigens, allergens, etc. is clearly within the scope of the invention.

As used in this specification and the appended claims, the terms "comprise", "comprising", "comprises" and other forms of these terms are intended in the non-limiting inclusive sense, that is, to include particular recited elements or components without excluding any other element or component. Unless defined otherwise all technical and scientific terms used herein have the same meaning as commonly understood to one of ordinary skill in the art to which this invention belongs. As used herein, "about" means+ or −5%. The use of the alternative (e.g., "or") should be understood to mean one, both, or any combination thereof of the alternatives, i.e., "or" can also refer to "and."

As used in this specification and the appended claims, any concentration range, percentage range, ratio range or other integer range is to be understood to include the value of any integer within the recited range and, when appropriate, fractions thereof (such as one tenth and one hundredth of an integer), unless otherwise indicated. For example, although numerical values are often presented in a range format throughout this document, a range format is merely for convenience and brevity and should not be construed as an inflexible limitation on the scope of the invention. Accordingly, the use of a range expressly includes all possible subranges, all individual numerical values within that range, and all numerical values or numerical ranges including integers within such ranges and fractions of the values or the integers within ranges unless the context clearly indicates otherwise. This construction applies regardless of the breadth of the range and in all contexts throughout this patent document. Thus, to illustrate, reference to a range of 90-100% includes 91-99%, 92-98%, 93-95%, 91-98%, 91-97%, 91-96%, 91-95%, 91-94%, 91-93%, and so forth. Reference to a range of 90-100%, includes 91%, 92%, 93%, 94%, 95%, 95%, 97%, etc., as well as 91.1%, 91.2%, 91.3%, 91.4%, 91.5%, etc., 92.1%, 92.2%, 92.3%, 92.4%, 92.5%, etc., and so forth. Reference to a range of 5-10, 10-20, 20-30, 30-40, 40-50, 50-75, 75-100, 100-150, and 150-175, includes ranges such as 5-20, 5-30, 5-40, 5-50, 5-75, 5-100, 5-150, 5-171, and 10-30, 10-40, 10-50, 10-75, 10-100, 10-150, 10-175, and 20-40, 20-50, 20-75, 20-100, 20-150, 20-175, and so forth. Further, for example, reference to a series of ranges of 2-72 hours, 2-48 hours, 4-24 hours, 4-18 hours and 6-12 hours, includes ranges of 2-6 hours, 2, 12 hours, 2-18 hours, 2-24 hours, etc., and 4-27 hours, 4-48 hours, 4-6 hours, etc.

Certain abbreviations, as used in this specification and the appended claims, are defined as follows: AR: Allergic rhinitis; BLAGA: *Blattella germanica* allergen; IA: Intermediate asthma; MMA: Mild/moderate asthma; NBGA: Novel Bla g antigen; ORF: Open reading frame; PBMC: Peripheral blood mononuclear cells; RACK1: Receptor for activated protein kinase C; SA: Severe asthma; SFC: Spot forming cells; TG: Timothy grass; and TPI: Triosephosphate isomerase.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims. The invention is further exemplified by way of the following non-limited examples.

The invention is further exemplified by way of the following non-limited examples.

EXAMPLES

Example 1

This example includes a description of various materials and methods.

Study subject populations: Subjects displaying symptoms of allergic rhinitis were recruited from St. Louis, New York City, Boston, and Cleveland clinics, following Institutional Review Board approved protocols and informed consent. Each was assigned a study identification number. Subjects with a skin prick test (wheal ≥3 mm) and IgE titers toward Bla g extract (≥0.35 kUA/L by ImmunoCAP assay) were classified as Bla g sensitized. Otherwise, individuals with negative skin prick tests and negative IgE titers were classified as controls. Subjects were further classified as allergic rhinitis and no asthma (AR), intermittent asthma (IA), mild/moderate asthma (MMA), or severe asthma (SA)) by clinical history, questionnaires, and medication scores. Asthma or allergic rhinitis status was based on having either 1) diagnosis by a doctor over 1 year before recruitment, or 2) meeting specific symptom criteria if no diagnosis or a recent diagnosis. Asthma severity classifications were based on current controller medication requirements and use of prednisone in the last year. Cockroach-sensitive individuals who were screened and did not meet these criteria were not enrolled.

Pertinent subject information is summarized in Table 3. In addition, a group of ten non-allergic donors (no allergic rhinitis symptoms and non Bla g sensitized) recruited in the San Diego area were included as non-allergic controls.

Generation of Bla g Transcriptome: *Blattella germanica* females used for the whole transcriptome analysis were obtained from a colony reared at the Institut de Biologia Evolutiva (CSIC-UPF) at 30° C. and 70% humidity, supplied with water at libitum and a commercial dog food diet. The whole transcriptome was analyzed in three different tissues, fat body, ovary, and epidermis. Fat body and ovaries were taken from 3-day-old to 5-day-old adults, while the epidermis was obtained from the thoracic dorsum of 5-day-old and 6-day-old 6$^{th}$ instar nymphs. Three animals were used to pool ovary and epithelium, and five were necessary to pool the fat body. Total RNA was extracted with the GenElute™ Mammalian Total RNA Miniprep Kit (Sigma-Aldrich). RNA samples were sent to be sequenced at GATC-Biotech (Konstanz, Germany) by Roche™ pyrosequencing technology (454), a method of choice for generating library data from those species without genome annotated[30,31], as it provides large reads that facilitates the de novo assembly. Data from the four libraries are accessible at the GEO database (accession code GSE63921).

Proteomic Analysis of Bla g Extract: Novel Bla g antigens were identified as described in Schulten, et al 2013 for TG. Briefly, Bla g extract (Greer, cat #XPB46D3A4) and pooled sera from 15 Bla g allergic subjects were submitted to Applied Biomics for analysis. 2-D gels (3-10 pH range, 12% (vol/vol) acrylamide) of Bla g extract were incubated with the pool of sera and stained with goat anti-human IgE and rabbit anti-human IgG (Sigma-Aldrich), and visualized by using Cy2-conjugated donkey anti-goat IgG and Cy5-conjugated donkey anti-mouse IgG antibodies (Biotium). This was followed by mass spectrometry analysis of positive IgE and/or IgG protein spots and MALDI spectra were compared against the Bla g transcriptome, using MASCOT. 16 unique novel potential ORFs were identified (Table 4). A more detailed description of proteomic identification is in Supplementary Methods.

Peptide Synthesis and MHC Class II Binding Predictions: 809 15-mer peptides overlapping by 5 residues were synthesized covering Bla g allergens, Bla g 1-9 and 11. In addition, from the proteomic identified sequences, 646 15-mer peptides with predicted promiscuous binding to MHC class II alleles were selected as described (Paul et al, submitted) and synthesized. Finally, 233 promiscuous binding 15-mer peptides from recently identified antigens (vitellogenin, Hsp60, enolase, triosephosphate isomerase (TPI), trypsin, and RACK1) were synthesized. In total, 1514 15-mer peptides were synthesized for epitope identification (Table 5). A more detailed description of binding prediction and peptide synthesis is in Supplementary Methods.

PBMC Isolation and Cell Cultures: PBMC (peripheral blood mononuclear cells) were isolated from 450 mL (one unit) of blood by density gradient centrifugation as described and cryopreserved. For in vitro expansion of PBMC for peptide screening, cells were cultured in RPMI1640 (Omega Scientific)+5% human AB serum (Gemini Bioscience), GlutaMAX (Gibco), and penicillin/streptomycin (Omega Scientific) at $2\times10^6$ per mL, stimulated with 10 ug/mL Bla g extract (Greer), and incubated at 37° C. in 5% $CO_2$. Every three days, IL-2 and IL-7 (10 U/mL) were added to the cultures. Cells were harvested for peptide screening at day 14.

ELISPOT Assays: Production of IFNγ, IL-5, IL-17, IL-10, and IL-21 (as representative of $T_H1$, $T_H2$, $T_H17$, $T_R1$, and $T_{RH}$, respectively) in response to peptide stimulation was measured by ELISPOT as described previously. Antibodies used in ELISPOT were (coating and secondary, respectively): for IFNγ/IL-5 dual plates: anti-IFNγ clone 1-D1K and anti-IL-5 clone TRK5, anti-IFNγ-HRP clone GZ-4 and anti-IL-5-biotin clone 5A10; for IL-10/IL-17 dual plates: anti-IL-10 clone 9D7 and anti-IL-17 clone MT44.6, and anti-IL-10-ALP clone 12G8 and anti-IL-17-biotin clone MT504; for IL-21 single plates: anti-IL-21 clone MT21.4/821 and anti-IL-21-biotin clone MT21.3m (all from Mabtech). In brief, $1\times10^5$ cells per well were incubated with peptide, peptide pool, or Bla g extract (10, 5, and 10 ug/ml, respectively) on anti-lymphokine antibody coated ELISPOT plates (Millipore #MSIPS4510) for 22 hours. Subsequently, secondary anti-lymphokine antibodies were added and incubated for 2 hours, washed, and avidin-peroxidase complex added for 1 hour. Plates were washed and spots developed with 3-amino-9-ethylcarbazole (Sigma #A6926) and Vector Blue (Vector #SK-5300) for IFNγ/IL-5 and IL-10/IL-17 dual plates or TMB (Sigma #T0565) for single IL-21. Criteria for peptide pool positivity were at least 100 spot forming cells (SFC) per $10^6$ PBMC, p<0.05, and stimulation index≥2. Criteria for peptide positivity were identical except with a threshold of 20 SFCs.

Example 2

This example includes a description of various Supplementary materials and methods.

Identification of novel Bla g extract proteins: To identify IgE and IgG reactive proteins from whole Bla g, a cockroach extract sample was run on two 2-D gels [3-10 pH range, 12% (vol/vol) acrylamide] followed by MS analysis of individual proteins spots (performed by Applied Biomics). One gel was stained with Coomassie blue, and the other was blotted onto a nitrocellulose membrane. The membrane was then incubated with 5% dried milk in PBS/0.05% Tween to block nonspecific binding, and subsequently probed with serum pooled from five Bla g-sensitive individuals at a dilution of 1:250. IgE and IgG binding were detected using goat anti-human IgE and rabbit anti-human IgG (Sigma-Aldrich), and visualized by using Cy2-conjugated donkey anti-goat IgG and Cy5-conjugated donkey anti-mouse IgG antibodies (Biotium).

Spots recognized by IgG, IgE, both or neither, were selected from the 2D blot, and the corresponding spots were identified on the stained SDS gel, cut out, and washed several times to remove staining dye and other inhibitory chemicals. To ensure that the correct spots were identified on the unstained gel, all gels (gel that was blotted, gel that was stained with Coomassie, and the unstained gel from which the spots were eventually picked) were run at the same time and under the exact same conditions to allow the assumption that the proteins run in the same x-y positions of the gels. Furthermore, for the spots selected from the blot, specialized software was used. Proteins on both the Western blot and the unstained gel were labeled with CyDye, which the software was able to align to ensure that the automated spot picker selected the right spots.

Spots were then dried to absorb maximum digestion buffer. Dried 2D gel spots were rehydrated in digestion buffer containing trypsin. Proteins were digested in gel at 37° C. and then extracted from the gel with TFA extraction buffer. Subsequently, the peptides were desalted by using C-18 Zip-tips, (Millipore) mixed with an α-cyano-4-hydroxycinnamic acid matrix, and spotted into wells of a MALDI plate. Mass spectra of the peptides in each sample were obtained by using an Applied Biosystems Proteomics Analyzer.

Generation of putative protein transcripts for epitope predictions: In parallel, we obtained transcripts from Bla g mRNA that had been deep-sequenced by X. Belles (Institute of Evolutionary Biology, Barcelona Spain). Freshly ecdysed sixth (last) instar nymphs and adult females of the Bla g were obtained from a colony reared in the dark at 30±1° C. and 60-70% relative humidity. For the WB-6 samples, the entire animal except the head (to avoid interferences with the eye pigments) and the digestive tube (to avoid contamination with parasites) was used. Stage specific samples of 2-3 individuals were collected for each of the 9 days of the last instar nymph. Then a pool composed by day 0 to 8 aliquots was built in order to cover the entire last instar nymph. For the Ov-A samples, we dissected the ovary pair from adult virgin cockroaches in each day of the first gonadotrophic cycle, which lasts 8 days. The pooling procedure to get an extract covering in this case the whole first gonadotrophic cycle was equivalent to that followed in the WB-6 extract. All dissections and tissue sampling were carried out on carbon dioxide-anaesthetized individuals. RNA isolation from WB-6 and Ov-A samples was carried out with mirVana miRNA Isolated kit (Ambion), which increases the yield of small RNAs. The total amount of RNA in WB-6 and Ov-A samples was approximately 10 µg. Sequencing was performed on an Illumina Genome Analyzer with Solexa technology.

The spectra were compared with the amino acid sequences encoded by the longest putative ORFs from the each of the de novo-assembled cockroach transcripts. All ORFs that had a >95% confidence hit as evaluated by the Mascot software package (Matrix Science) were considered hits. The amino acid sequences encoded by these ORFs were used for epitope prediction.

Epitope prediction from Bla g proteins: Next the novel sequences were analyzed to predict HLA class II promiscuous binders. Protein ID details (total protein IDs count=95) were narrowed to consider only protein details with "high confidence" (76 entries), and further narrowed by removing duplicate accession numbers. The remaining 37 sequences were clustered using Epitope Cluster Analysis tool available through the IEDB Analysis Resource (http://tools.immuneepitope.org/tools/cluster/iedb_input) and BLAST 2 Sequences at NCBI (www.ncbi.nlm.nih.gov/blast/b12seq/wblast2.cgi). The longest sequence in each cluster was considered as the reference sequence for the particular cluster and all other sequences in the cluster were aligned to the reference sequence using MEGA (http://megasoftware.net/). All sequences in each cluster were >60% identical to the respective reference sequence with >75% sequence coverage. A total of 19 unique clusters were obtained.

Next, each cluster was compared to known allergens from allergen.org. Cluster-8 was found to correspond to the known allergen Bla g 7, and was thus excluded from further analysis. Cluster-2 was 53% identical out of 96% coverage to the Per a 3 allergen from *Periplaneta americana* (American cockroach) & 51% identical out of 95% coverage to Bla g 3. However, as Bla g 3 has not been previously characterized (and is not present in allergen.org), Cluster-2 was retained in the analysis.

Each of the 18 remaining clusters was subjected to BLAST analysis at GenBank to identify similar proteins, and the best hit was noted. The 6 known Bla g allergens (1, 2, 4, 5, 6, 7) were included as a control set. To generate 15-mers for all protein clusters separately we generated 15-mer peptides overlapping by 10 residues, starting at position 1, and included a peptide covering the C-terminus. For example, for a 27-residue protein peptides 1-15, 6-20, 11-25 and 13-27 would be selected. For Clusters-1 and -2, all 15-mers from the reference sequence (longest sequence+ other sequences at the ends if applicable) were included and additionally the 15-mers from other proteins of the same cluster that had 2 or more amino acid substitutions were also included. We removed 15-mers with 'X' (3 from Cluster-16, 3 from Cluster-18 and 2 from Cluster-19).

To characterize the predicted HLA class II binding capacity of each peptide, we selected 24 common alleles for which algorithms were available. The MHC binding affinity for all 15-mers for each allele was generated using the stand-alone version of IEDB's MHC class II epitope prediction tool. Each allele was predicted independently using the IEDB's recommended approach, which for all alleles except DRB3*02:02 was the consensus method; for DRB3*02:02, where nn_align & smm_align methods are currently not available, the IEDB recommended is NetmhcIIpan. For each 15-mer, the number of alleles with an IEDB percentile score ≤20 was tabulated as a measure of promiscuity. All 15-mers predicted at the $20^{th}$ percentile for 12 or more alleles (i.e., ≥50% of the total no. of alleles considered) were considered promiscuous binders. For clusters that had less than 5 15-mers at the above threshold, the selection threshold was lowered so as to include at least 5 15-mers from each cluster.

To ensure that each allergen is adequately represented in the final selected peptide set, the number of peptides for each protein cluster was determined after excluding peptides located within the first 20 residues of the N-terminus (which likely contain signal sequences) as well as redundancy from directly overlapping peptides (e.g., for peptides spanning 56-70 and 61-75, only the one with the highest predicted promiscuity was selected). Cluster-18 had only one valid peptide as per these criteria while all others had greater than or equal to 2 peptides. Accordingly, the selection threshold for Cluster-18 was also lowered until an additional peptide was identified; thereby ensuring that in the final selection at least 2 peptides from each cluster was included. In total, a final set of 318 predicted binders was selected from the novel allergen set, and synthesized as crude material on the 1 mg scale.

Epitope prediction from recent Bla g sequences from literature: Following a methodology similar to that described above, 15-mers were generated to span each of 8 novel Bla g antigens from both references (i.e., 2 from Jeong and 6 from Chuang)[11,17], as per standard protocol after aligning the sequences with previously identified proteins. We next predicted binding affinity for all 15mers for 24 class II alleles as above (Section 4). For all 15-mers the number of alleles with an IEDB percentile score ≤20 was tabulated as a measure of promiscuity. All 15-mers with 12 or more alleles (50% of the total no. of alleles considered) predicted at that threshold were selected as candidate promiscuous binders (n=178). Further analysis identified that 110 of these peptides were already present in sets of previously selected binders. After removal of these redundant peptides, final set of 68 new promiscuous binders was selected for further analysis. Of these 68, 8 are variants of the previously predicted binders. All 8 novel antigens identified in the Jeong and Chuang studies were represented by at least 5 15-mers in the final set of 68 selected peptides (and all 8 antigens were represented by more than 2 15-mers after exclusion of signal sequence region and directly overlapping 15-mers). These peptides were also synthesized as crude material on the 1 mg scale (3561 series).

Example 3

This example includes a description of study design for immunological characterization of Bla g allergens.

To characterize reactivity of Bla g sensitized subjects as a function of disease severity, we assembled a cohort of 90 subjects adult study participants, recruited from St Louis, New York City, Boston, and Cleveland (Table 3). Each donor provided a unit blood donation and was classified as Bla g sensitized (Bla g IgE titer ≥0.35 kUA/mL and skin prick test wheal ≥3 mm) or as control (≤0.35 Bla g IgE titer and skin prick test). Sensitized individuals were classified as allergic rhinitis and no asthma (AR), intermittent asthma (IA), mild/moderate asthma (MMA), or severe asthma (SA) based on clinical history, questionnaires, and medication scores. These subjects were 77% female and ranged in age from 19 to 56.

We synthetized overlapping peptide sets of 15 amino acids in length overlapping by 10 residues and covering the entire sequence of known Bla g Allergens, i.e. Bla g 1-7, 9 and 11, referred from hereafter collectively as BLAGA. A total of 809 BLAGA peptides were arranged in pools, encompassing on average 20 peptides.

Example 4

This example includes a description of differential immune reactivity and immunodominance against Bla g allergens in sensitized versus non-sensitized controls.

To assess T cell reactivity, we utilized a strategy applied to the definition of epitopes from various allergen sources[15,16] utilizing in vitro stimulation with allergen extracts. Here, PBMC from each subject were stimulated in vitro with Bla g extract. After 14 days, pools of overlapping 15-mer peptides from the BLAGA were tested for responses, and positive pools deconvoluted to identify the specific epitopes. As readout, we utilized ELISPOT assays specific for IL-5, IFNγ, IL-10, IL-17 and IL-21, chosen as representative of $T_H2$, $T_H1$, $T_R1$, $T_H17$ and $T_{FH}$ reactivity, respectively.

FIG. 1A, depicts for each subject the overall response (expressed as total $SFC/10^6$ PBMC for all BLAGA and for all cytokines). Vigorous T cell responses were detected against BLAGA in Bla g sensitized donors. As expected, the non-Bla g sensitized controls were associated with lower responses.

Figure 1B:
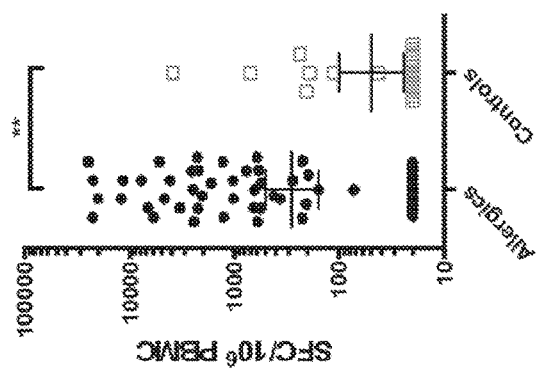

In the sensitized donors, Bla g 5, Bla g 4, Bla g 9 and Bla g 11 were immunodominant (FIG. 1B). In the non-Bla g sensitized controls Bla g 4 and 9 were still relatively imunodominant, while Bla g 5 and Bla g 11 were hardly recognized at all.

Figure 1C:
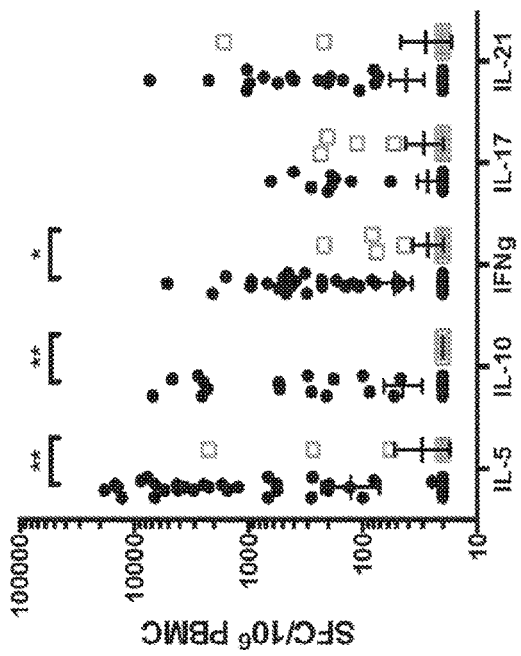

As expected, the most dominant cytokine detected in Bla g sensitized individuals was IL-5 (FIG. 1C), followed by IL-10 and IFNγ. The levels of IL-5, IFNγ, and IL-10 were significantly lower in non-sensitized controls, and in fact IL-10 secretion in response to BLAGA was not detected in the control subjects. Lower levels of IL-17 and IL-21 were also detected, not significantly different between sensitized and control individuals.

Example 5

This Example Includes a Definition of Novel Bla g T Cell Antigens.

In the studies described above, 44% of sensitized subjects responded to extract stimulation but did not respond to any of the BLAGA peptides (data not shown). This suggested that additional uncharacterized antigenic proteins are present in the extract, in addition to the ten BLAGA commonly described.

Figure 2A:
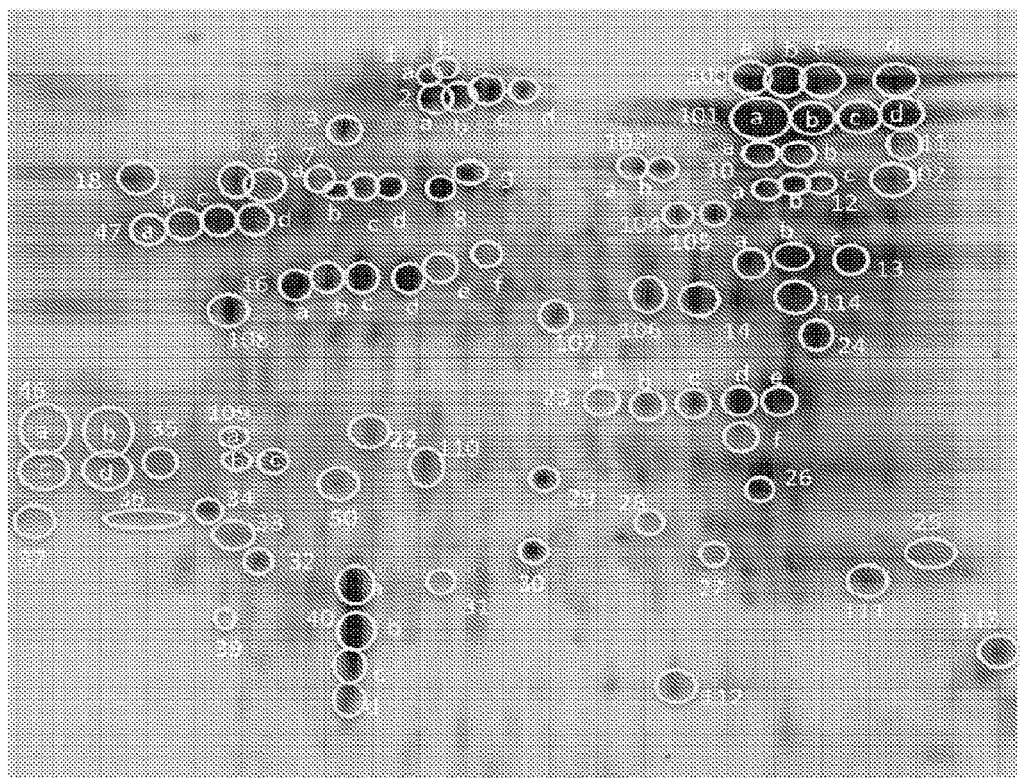
FIGS. 2A-2B show Identification of Novel Bla g antigens by 2-D Gel Immunoblot. A) Coomassie stain of 2-D gel of Bla g extract. B) Separated Bla g extract stained with pooled serum from 15 Bla g allergic subjects. Green spots indicate IgE binding; red spots indicate IgG binding; and yellow spots indicate dual IgE/IgG binding. Yellow circles indicate sections selected for proteomic analysis.
Figure 2B:
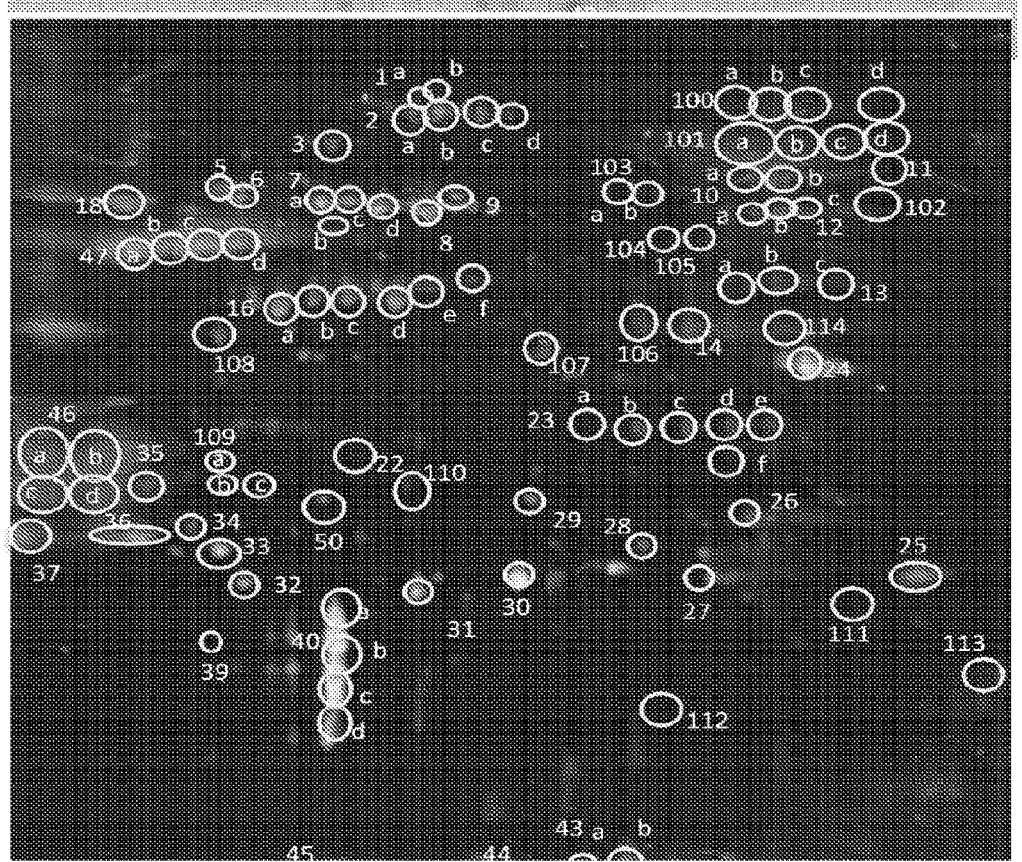

Schulten et al recently described how novel T cell antigens can be discovered by a proteomic approach combined with HLA-binding predictions[16,32]. The same approach was utilized here to identify potential novel Bla g antigens. To this end, transcripts from Bla g mRNA were deep-sequenced. Subsequently, 2-D gels of Bla g extract followed by mass spectrometry analysis of individual protein spots and MALDI spectra of the peptides from these spots were used to derive sequences (FIG. 2). These transcripts along with the MALDI-derived peptide sequences were assembled in 16 unique novel potential ORFs, referred to hereafter as NBGA 1-16 (Novel Bla g Antigens; Table 4 and 7). Independently using similar proteomic techniques, Jeong and colleagues[11,33] and Chuang and colleagues[16,17] identified additional NGBA, including Enolase, Hsp60, RACK1, TPI, Trypsin and Vitellogenin. In total, these studies defined 22 different NBGA, 7 of which were non-IgE reactive, and 15 of which had IgE reactivity as defined by the immunoblot analysis of FIG. 2 and the Jeong and Chuang studies[11,17] These sequences were scanned for predicted promiscuous HLA class II binding peptides using a prediction scheme previously described[16]. A total of 879 peptides were selected for synthesis.

Example 6

This example includes data demonstrating that NBGA induce a substantial proportion of total T cell responses.

Figure 3A:
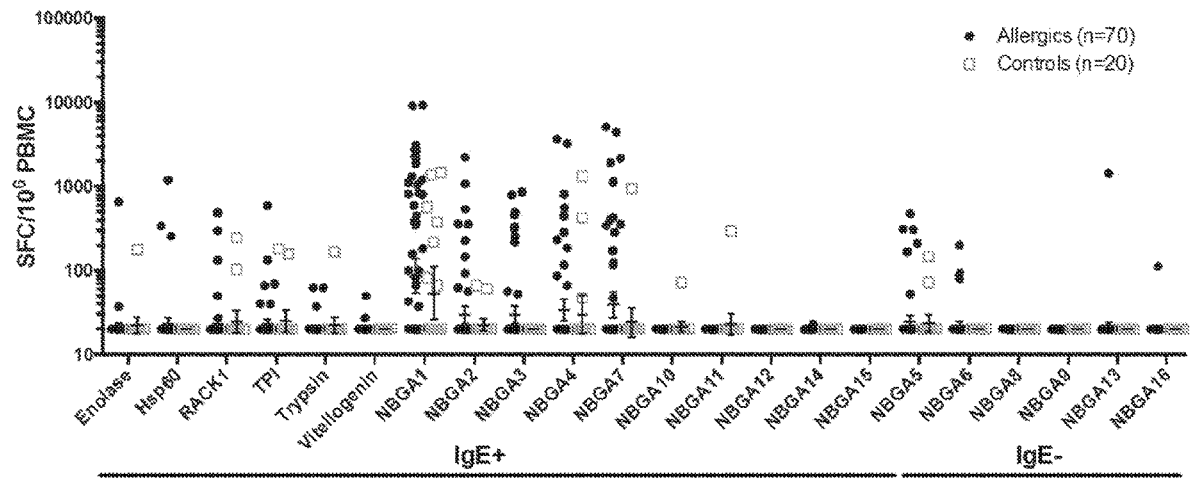
FIGS. 3A-3B show CD4$^+$ T Cell Reactivity to Novel Bla g Antigens. A) Individual NBGA responses (sum of all cytokines) of Bla g sensitized and control subjects after 14-day expansion with Bla g extract followed by 24-hour stimulation with NBGA peptides. B) Pattern of cytokine responses detected against IgE+ and IgE-NBGA in allergic and control subjects. Geometric means and 95% confidence intervals shown. **$p<0.0001$,*$p<0.001$,**$p<0.01$, by non-parametric Mann-Whitney t-test.

To determine if NBGA were targeted by T cell responses in sensitized subjects, cytokine release in response to each peptide, following 2-week in vitro extract stimulation was measured in similar fashion to FIG. 1. A total of 13 NBGA were associated with detectable levels of cytokine release in more than one subject (FIG. 3A). The novel antigen, NBGA1, dominated the response (FIG. 3A), accounting for approximately half of total NBGA response. Significant reactivity was also observed for several other antigens, including NBGA2-5, NBGA7, TPI and RACK1. By contrast, ten other antigens (NBGA8-16 and vitellogenin) were essentially negative for any cytokine specific responses.

As in the case of the BLAGA responses, different immunodominance patterns were observed in the controls as compared to the sensitized individuals. For example, NBGA1 was recognized as dominant in both sensitized and controls, while NBGA7 was essentially recognized only in sensitized individuals.

Figure 3B:
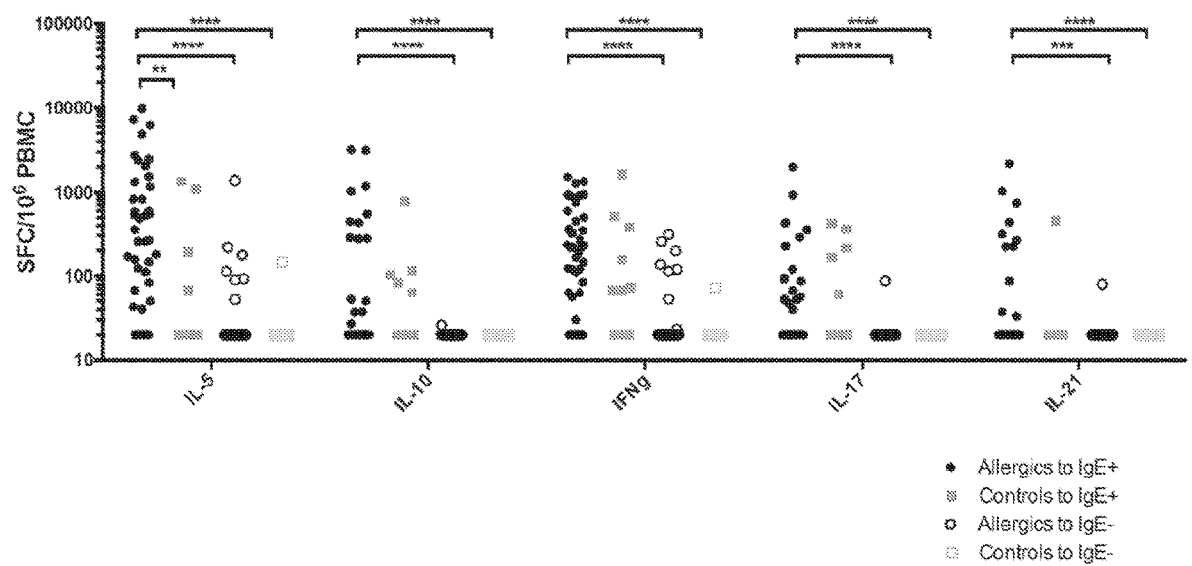

Remarkably, most of the reactivity of sensitized subjects was encompassed by IgE+ NBGA (shown in the left of FIG. 3A), while, with exception of the NBGA5, IgE-NBGA (shown in the right of FIG. 3A) were essentially negative. IgE+ NBGA reactivity for all cytokines was stronger compared to IgE-NBGA (FIG. 3B). IL-5 encompassed the majority of the response, but IFNγ, IL-10, IL-17, and IL-21 responses were also detected. Non-sensitized control subjects also preferentially recognized IgE+ NBGA, but with lower magnitudes than sensitized individuals (FIG. 3B). In conclusion, the data presented in this section demonstrate that significant T cell reactivity is associated with NGBA antigens, mostly directed to IgE+ positive antigens.

Example 7

This example includes data demonstrating breadth and immunodominance at the epitope level.

Overall, a total of 465 peptides were recognized in at least one of the subjects. Many of these peptides overlap each other and as such likely to encompass the same epitope. The data was examined next to eliminate redundancy and overlaps, as described in the methods section. Accordingly, a set of 356 non-redundant epitopes was derived.

Figure 4A:
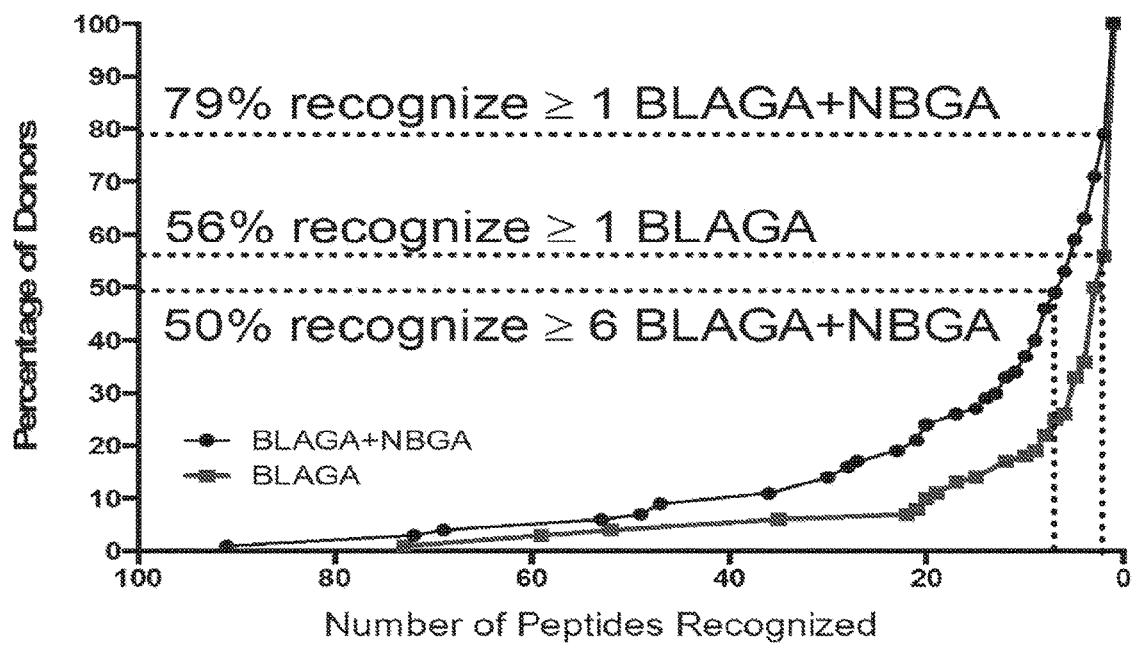
FIGS. 4A-4B show Immunodominance of Bla g Epitopes. A) Comparison of the percentage of the total cytokine response per epitope. BLAGA represented by blue circles. Combined BLAGA and NBGA represented by black circles. B) Comparison of the number of epitopes recognized per subject among the Bla g sensitive subjects.

The patterns of immunodominance and breadth of responses at the level of individual epitopes are shown in FIG. 4. A total of 56% of the sensitized subjects recognized at least one BLAGA epitope. Combining BLAGA and NBGA epitopes increased the percentage of subjects responding to at least one epitope to 79% (FIG. 4A). Thus, combined use of epitopes derived from BLAGA and NBGA accounts for coverage of a larger percentage of Bla g sensitive individuals than would be possible with either antigen class alone.

Figure 4B:
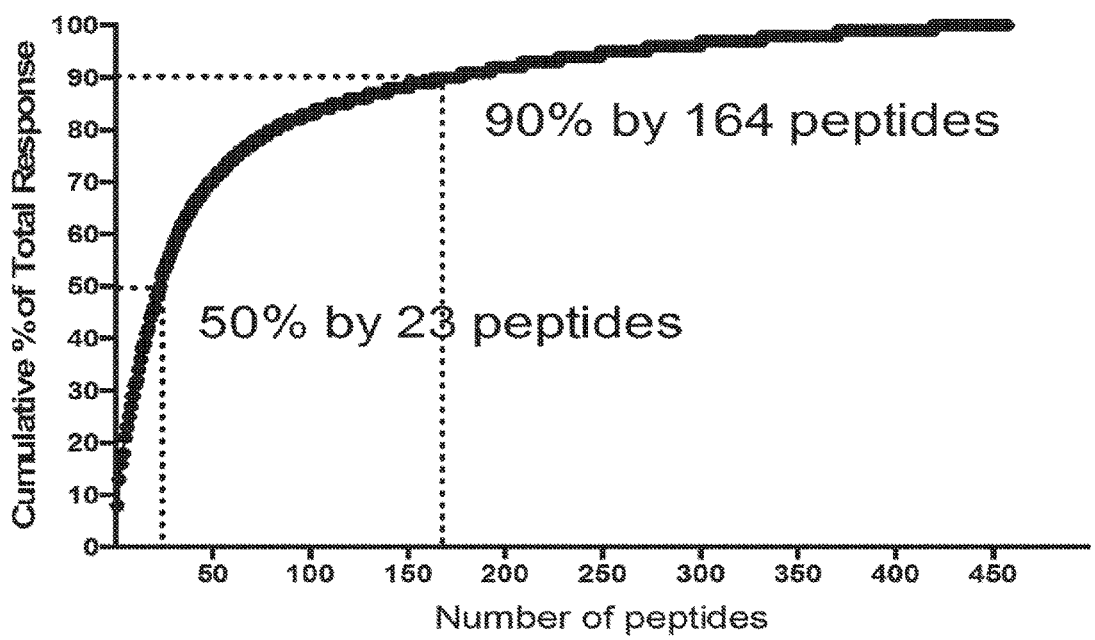

Overall, 50% of the subjects recognized 6 peptides or more (FIG. 4A). To account for 90% of the total response 164 epitopes, were required and 23 epitopes were required to capture 50% of the responses (FIG. 4B). A list of these 164 epitopes, and the corresponding average magnitudes and response rates, is provided in Table 6. Overall, these data underline the remarkable breadth of responses detected in sensitized donors, and clearly points to the value of a systematic epitope identification effort, to allow comprehensive coverage of the patient population and examination of the pattern of immune recognition associated with each individual subject.

Example 8

This example includes data demonstrating that polarization of T cell responses correlates with sensitization status, while magnitude of T cell responses correlate with Asthma status.

Figure 5:
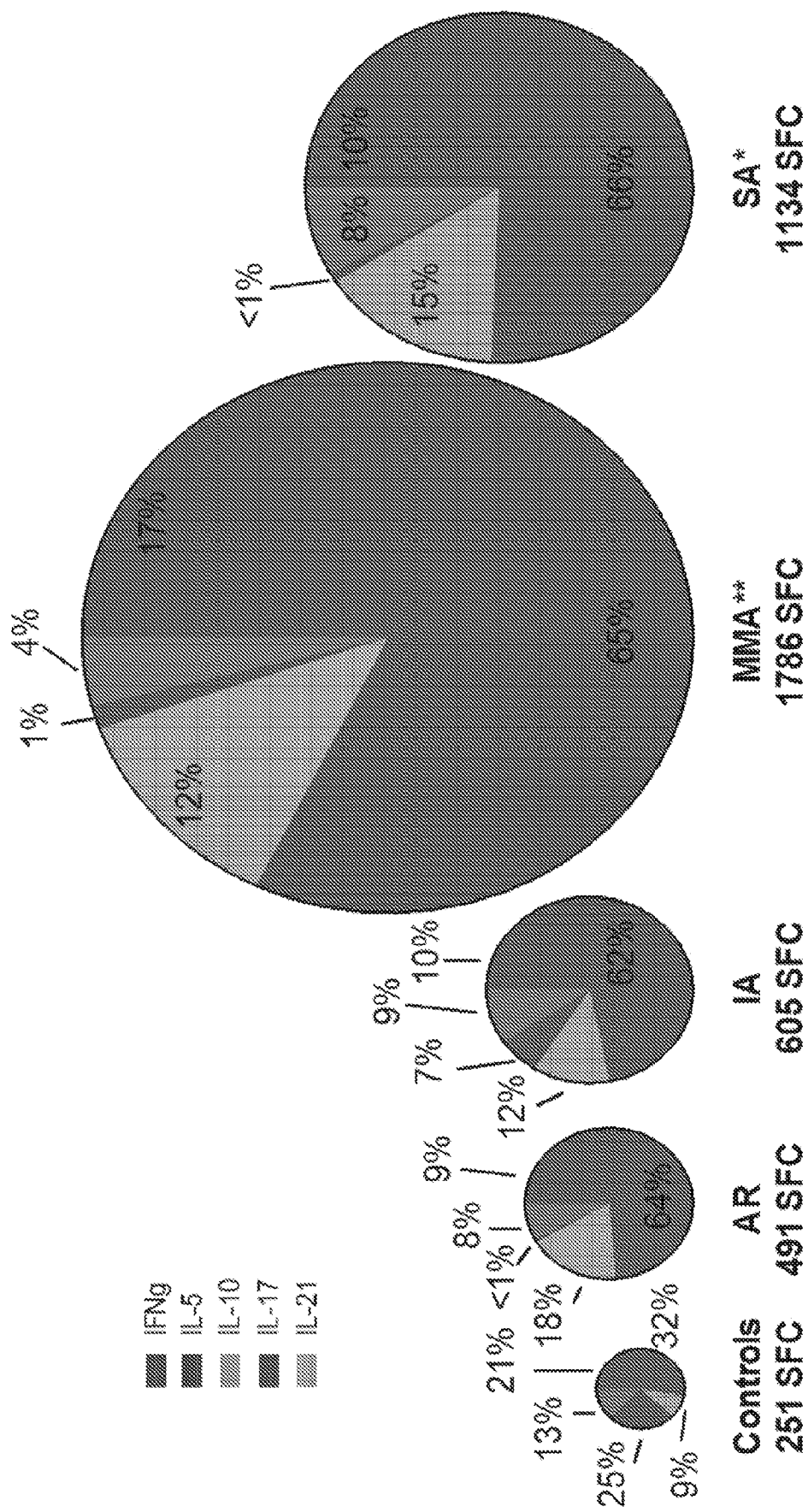
FIG. 5 shows Changing Magnitude and Polyfunctionality of Responses Among Asthma Severities. Height of pie chart is proportional to geometric mean of the total sum of responses for subject group. Numerical values inside pie charts are percentage of total response encompassed by the individual cytokine response. Red denotes relative proportion of IFNγ responses, blue IL-5, green IL-10, purple, IL-17, and gray IL-21. *$p<0.05$, **$p<0.005$, calculated by non-parametric Mann-Whitney t-test.

In the next series of analyses, we correlated magnitude and functionality of Tx subset responses with the sensitization and asthma status as defined above. In terms of magnitude of responses, a geometric mean magnitude of 251 SFC/10^6 cells was noted in non-sensitized controls (FIG. 5). The magnitude of responses progressively increased in AR subjects (491 SFC), patients with IA (605 SFC), and MMA (1786 SFC, p<0.05 to controls). Responses were somewhat lower in SA (1134 SFC), although still significantly higher than the control group, perhaps reflective of the immunosuppressive nature of medications administered to the SA group.

In terms of polarization of T cell responses, similar to what was observed for TG 16,18 allergy, the cytokine patterns observed in Bla g allergic patients was highly polarized, with responses in all allergic subjects being dominated by IL-5, and accounting for ⅔ of the response across all groups. This pattern was similar regardless of the AR versus asthma status of the sensitized donors. By contrast, the T cell response in control subjects was not highly polarized, with similar amounts of IL-5 (32%), IFNγ (21%) and IL-10 (25%) being detected. Thus, the sensitization status correlated with increased IL-5 polarization of responses to Bla g antigens while the AR versus Asthma status correlated with increased magnitude of response.

Example 9

This example includes data showing differential immunodominance of BLAGA and NBGA in control, rhinitis and asthmatic subjects.

We next investigated the immunodominance patterns for BLAGA and NBGA antigens (FIG. 6 and Table 1). Table 1 lists, for each antigen and subject category, the percentage of subjects responding and the average total response/donor associated with each particular antigen. FIG. 6 shows the same data in a pie chart format, in which the study subjects were divided in non-sensitized controls, sensitized non-asthmatics, and sensitized asthmatics. We expected, based, on the data shown in FIGS. 1 and 3, that a different pattern of immunodominance would be observed between sensitized and non-sensitized individuals.

In non-sensitized controls >70% of the total response was encompassed by the two antigens, Bla g 9 and NBGA1 (FIG. 6A and Table 1). In subjects with allergic rhinitis (FIG. 6B and Table 1). NBGA1 still encompassed a significant proportion of the response (21.3%), however Bla g 4 was the most dominant (31.8% of response), and the response to Bla g 5 (21.6%) was equivalent to that seen in NBGA1 (21.3%).

Intriguingly, the pattern further shifted in the sensitized asthmatic donors (FIG. 6C and Table 1). Bla g 5 and NBGA1 still accounted for large proportions of the response (32.7% and 11.9%, respectively), but responses to Bla g 4 were nearly absent (1.6%). Responses to Bla g 9 increased to 24.4%, and Bla g 11, which had very low responses in controls and rhinitis, increased to 8.1%.

Remarkably, Bla g 2, which is a dominant target of IgE responses along with Bla g 5, accounted for only a minor fraction (<1%) of T cell reactivity among both rhinitis and asthmatic subjects, highlighting the lack of correlation between immunodominance for IgE and T cell responses, in agreement with what has been previously reported in other allergies[15,18].

When the pattern of responsiveness amongst different asthma severity was considered, some further minor differences were observed. For example, NBGA1 and 7 seemed to be recognized most prominently in IA subjects (Table 1), but overall similar patterns were observed in the different categories of asthmatic patients.

Example 10

This example includes data showing differential epitope recognition as a function of disease state.

Based on the above results, which showed differential patterns of relative immunodominance in sensitized and control individuals on one hand and asthmatic versus non-asthmatic subjects on the other hand, we hypothesized that the epitopes identified could be partitioned in sets associated with preferential recognition by specific patient groups.

The results of this in silico analysis shown in Table 2, define a set of 55 epitope sequences (Rhinitis Set in Table 2) accounting for 84% of the total response in the rhinitis subjects, but only 20% of the response of asthmatic subjects. Similarly, an epitope set of 147 epitopes (Asthmatic Set) could be defined, associated with preferential recognition (55% of total response) in Bla g sensitized subjects with asthma, but recognized in lower frequencies in rhinitis subjects (5%).

Example 11

This example includes data showing differential recognition of disease specific epitope pools.

We next validated the specificity of recognition for putative disease-state epitope sets. Randomly selected subjects from the AR and asthmatic groups were cultured in vitro for 14-days in the presence of epitope pools, followed by overnight restimulation with the respective epitope sets described in Table 2. After a 14-day in vitro restimulation as above, responses against the epitope sets were measured. Responses were measured by ELISPOT, and the relative and absolute IFNγ, IL-5, IL-10, IL-17, and IL-21 responses were calculated.

Figure 7A:
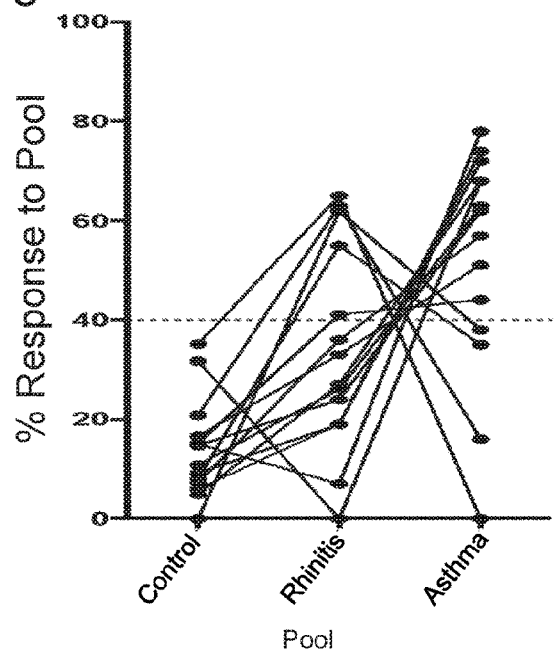
Figure 7B:
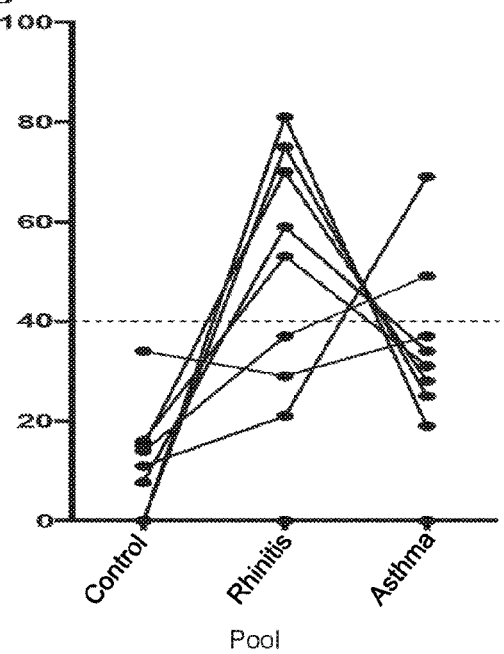
Figure 7C:
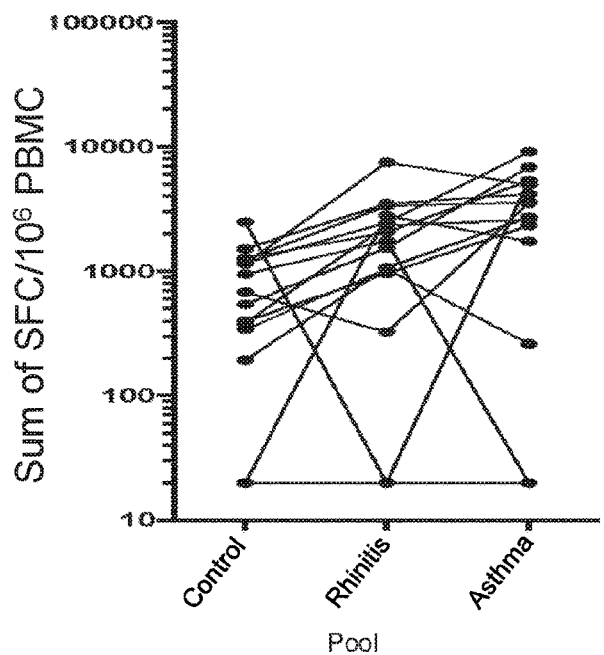
Figure 7D:
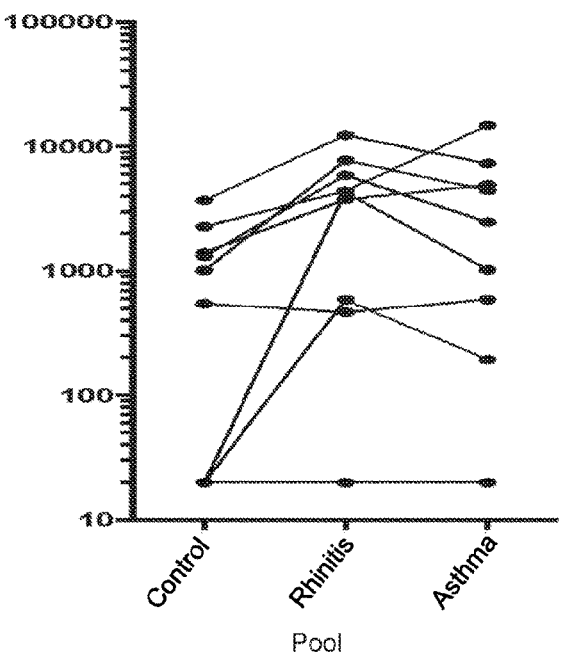

As seen in FIG. 7A the median percentage of responses of asthmatic subjects was highest in response to the Asthma Pools and decreased in the case of the Rhinitis Pools. In fact, for ten of 14 asthmatic subjects the largest proportion (>40%) of the response was directed to the Asthma Pools. Conversely, the responses observed in the AR (sensitized but non-asthmatic) subjects were dominated by the Rhinitis Pools (FIG. 7B). In fact, for five of the nine AR subjects the largest proportion (>40%) of response was directed to the Rhinitis Pools, Results were similar when the absolute magnitude of responses, rather than the relative magnitudes were plotted (FIGS. 7C-D). Similar trends were also noted when cultures were restimulated with extract followed by assay with the various peptide pools. In this case, the response rate for control and rhinitis subjects was much lower (data not shown), indicating that stimulation with high concentration of well-defined epitopes provides stronger stimulus. Overall the data suggest that these epitope pools could have potential applications to differentiate between Bla g sensitized rhinitis and asthmatic subjects.

Example 12

The following is a discussion of the data herein.

In this study, a thorough characterization of the CD4+ T cell responses in cockroach allergy is provided, at the level of the antigens and epitopes recognized, at the level of the functionality of associated T cell responses, and as a function of sensitization and asthmatic status. We determined if a differential "signature" would be associated with controls versus rhinitis only patients, and versus asthmatics. Surprisingly, differences in terms of antigens dominantly recognized in Bla g sensitized subjects with and without asthma, and also versus control subjects were observed. This represents the first report of differential recognition between asthmatics and non-asthmatics of T cell antigens in respiratory allergens in general and Bla g sensitized individuals in particular.

The study overall investigated the reactivity of approximately 1,600 different Bla g derived synthetic peptides. While over 400 peptides were associated with some measurable T cell responses, and a total of 164 different epitopes were recognized in multiple donors, and 23 of them accounted for 50% of the total response.

Previous to the studies herein, the nature of human T cell epitopes had not been systematically investigated in this system and only 30 Bla g T cell epitopes were described[15]. Accordingly, the studies herein expanded by more than an order of magnitude the number of epitopes available for study.

At the antigen level, the whole sequence of all classically defined Bla g allergens, Bla g 1, 2, 4-7, 9 and 11 was systematically investigated. These Bla g allergens only accounted for responses in 56% of Bla g sensitized individuals. To find the "missing" responses, transcriptomic/proteomic approach with Bla g extract and sensitized serum was employed. In Bla g extract, 16 novel antigens that had IgE and/or IgG reactivity in Bla g sensitized serum were identified. These novel antigens induced T cell responses in 43% of Bla g sensitized subjects, and the combined sets of Bla g and novel antigens were recognized by more than 79% of subjects.

Intriguingly, in direct contrast to what was detected for TG allergy, the non-IgE reactive antigens in Bla g extract had negligible T cell activity in all CD4+ subsets, suggesting a strong link between IgE and T cell activity in Bla g allergy. It is not apparent why different allergen species would have different patterns in IgE:T cell linkage at the antigen level. One possibility is that the T cell responses to TG epitopes from antigens that are not targeted by IgE are actually cross-reactive T cell responses specific for antigens from other pollen species that are targeted by IgE. Indeed, many TG epitopes show high cross-reactivity to other grass pollens. For Bla g antigens, a lesser degree of exposure to homologous antigens from other species may explain the stronger T cell:IgE linkage observed.

These data highlights how the combined transcriptomic/proteomic approach can expand the number of antigens associated with T cell reactivity. Given the fact that some of the sensitized donors which responded to extract did not see any of the known and novel proteins, it is likely that additional targets remain to be identified, which is also not completely surprising given the large number of proteins transcribed by the cockroach genome.

Certain allergens known to be dominant in terms of IgE responses, such as Bla g 2 was the target of only less than 4% of the total CD4+ T cell response to the Bla g antigens. Conversely other allergens less dominant at the IgE level, such as Bla g 9 and Bla g 4, and a novel antigen NBGA1 were immunodominant for T cell responses, accounted cumulatively for more than 75% of the response, similar to other reports[15,34] The NBGA5 antigen was fairly prominently recognized at the T cell level, despite not being targeted by IgE responses and would thus represent a potential candidate for safer T cell specific immunotherapy regimens.

Overall, the data suggests that Specific Immunotherapy approaches aimed at modulating T cell responses might not need to target the most dominant IgE binding proteins. Indeed, targeting the most dominant T cell antigens that are less prominent in terms of IgE binding might offer an effective and safer immunotherapeutic approach.

In terms of functionality and magnitude of T cell responses, as expected, the responses of non-sensitized donors were weaker and not effectively polarized. In the sensitized donors, the majority of the response was polarized to the $T_H2$ subset, but significant responses were also detected for lymphokines associated with $T_H1$, $T_H17$, $T_R1$, and $T_{RH}$ subsets. However in contrast to other reports on the correlation between $T_H17$ responses and asthma[24], the relative contribution of IL-17 response to Bla g antigens was equivalent between AR and asthmatic groups. The magnitude of responses was progressively increased in AR subjects, IA, and MMA. Responses were somewhat lower in SA group, although still significantly higher than the control group, perhaps reflective of the immunosuppressive nature of medications administered to the SA group.

The observed preferences in antigen recognition associated with clinical status, with the extensive epitope identification, was utilized to develop epitope sets that could differentiate between rhinitis and asthmatic subjects. These epitope sets could be used to isolate the corresponding allergen-specific cells and examining whether differences might exist at the level of their transcriptional or epigenetic profiles, or whether changes in the associated signatures might precede or follow the evolution of allergic disease, or asthma remission or exacerbation. In a broader sense, these epitope sets may have diagnostic value in providing a standardized laboratory test of asthmatic status.

TABLE 2

Bla g-Sensitivity and Asthma Classification by Epitope Sets. Epitope sets encompass epitopes denoted in Table 6. Percentages are calculated from the total response per subject to the epitope sets.

| Epitope Set | No. Epitopes | AR | Asthmatic |
| --- | --- | --- | --- |
| Control | 16 | <1 | 1 |
| Rhinitis | 55 | 84 | 20 |
| Asthma | 147 | 5 | 55 |

"—" denotes no response.

TABLE 3

Subject Cohort Information. Individuals classified as Bla g sensitized (wheal >3 mm and IgE titers >0.35 kUA/L) or control. Subjects further subdivided by asthmatic status based on history, questionnaires, and medication scores.

| Group/Asthma Severity | Female | Male | Age Range (years) | Bla g Wheal (mm) | Bla g IgE (kUA/L) |
| --- | --- | --- | --- | --- | --- |
| Control No Asthma | 7 | 6 | 21-56 | 0.2 | BLD |
| Control Intermittent | 2 | 3 | 22-33 | 0.2 | BLD |
| Control Moderate | 2 | 0 | 44-48 | 0.0 | BLD |
| Control Total | 11 | 9 | 21-56 | 0.2 | BLD |
| Bla g sensitized No Asthma | 12 | 4 | 20-45 | 5.4 | 9.5 |
| Bla g sensitized Intermittent | 28 | 3 | 19-53 | 6.0 | 6.9 |

TABLE 1

Differential Immunodominance of Bla g Antigens as a Function of Allergic Clinical Status.

| | Controls | | AR | | Asthmatic | | IA | | MMA | | SA | |
| --- | --- | --- | --- | --- | --- | --- | --- | --- | --- | --- | --- | --- |
| Antigen | % | SFC | % | SFC | % | SFC | % | SFC | % | SFC | % | SFC |
| Bla g 1 | 5 | 2 | — | — | 15 | 188 | 6 | 9 | 44 | 1044 | 15 | 24 |
| Bla g 2 | — | — | 12 | 44 | 9 | 44 | 3 | 26 | 33 | 154 | 8 | 12 |
| Bla g 4 | 4 | 54 | 18 | 1389 | 20 | 85 | 21 | 58 | 33 | 286 | 8 | 11 |
| Bla g 5 | 1 | 2 | 41 | 945 | 29 | 1704 | 21 | 1179 | 56 | 1827 | 31 | 2872 |
| Bla g 9 | 3 | 314 | 12 | 192 | 47 | 1275 | 39 | 715 | 67 | 2281 | 54 | 1914 |
| Bla g 11 | 2 | 6 | 18 | 170 | 36 | 424 | 30 | 416 | 44 | 676 | 46 | 271 |
| NBGA1 | 7 | 290 | 29 | 932 | 47 | 621 | 39 | 700 | 56 | 406 | 62 | 579 |
| NBGA2 | 2 | 6 | 12 | 78 | 13 | 78 | 12 | 40 | 11 | 246 | 15 | 53 |
| NBGA3 | — | — | 6 | 21 | 24 | 123 | 15 | 71 | 33 | 85 | 39 | 273 |
| NBGA4 | 3 | 30 | 24 | 289 | 16 | 136 | 18 | 151 | 22 | 197 | 8 | 59 |
| NBGA5 | 2 | 11 | 12 | 33 | 7 | 19 | 6 | 17 | — | — | 15 | 37 |
| NBGA7 | 1 | 50 | 29 | 194 | 16 | 287 | 18 | 442 | 22 | 96 | 8 | 49 |
| NBGA11 | 1 | 15 | — | — | — | — | — | — | — | — | — | — |
| Enolase | 1 | 9 | 6 | 3 | 6 | 42 | 3 | 27 | 11 | 151 | 8 | 3 |
| RACK1 | 2 | 30 | — | — | 9 | 19 | 12 | 31 | 11 | 3 | — | — |
| TPI | 2 | 17 | 6 | 13 | 11 | 31 | 6 | 6 | 11 | 83 | 23 | 54 |

"%" denotes percentage of subjects responding to given antigen.
"SFC" denotes the mean magnitude of response.
"—" denotes no response.
"Asthmatic" combines the responses across IA, MMA, SA.

TABLE 3-continued

Subject Cohort Information. Individuals classified as Bla g sensitized (wheal >3 mm and IgE titers >0.35 kUA/L) or control. Subjects further subdivided by asthmatic status based on history, questionnaires, and medication scores.

| Group/Asthma Severity | Female | Male | Age Range (years) | Bla g Wheal (mm) | Bla g IgE (kUA/L) |
|---|---|---|---|---|---|
| Bla g sensitized Mild | 3 | 1 | 35-51 | 5.5 | 17.9 |
| Bla g sensitized Moderate | 4 | 1 | 20-49 | 6.5 | 16.9 |
| Bla g sensitized Severe | 10 | 2 | 19-53 | 6.4 | 14.3 |
| Bla g Sensitized Total | 60 | 12 | 19-53 | 6.1 | 10.1 |

BLD = below limit of detection.

TABLE 4

Novel Bla g Proteins Discovered in Proteomic Screen. Full sequence mRNA accession IDs listed. Length of protein given in amino acid residues.

| Novel Bla g Antigen | Accession ID | Length |
|---|---|---|
| NBGA1 | AJ005115 | 1583 |
| NBGA2 | LN794619 | 731 |
| NBGA3 | LN794625 | 264 |
| NBGA4 | LN794631 | 1585 |
| NBGA5 | GBID01003088 | 718 |
| NBGA6 | LN794620 | 468 |
| NBGA7 | LN794623 | 343 |
| NBGA8 | LN794629 | 207 |
| NBGA9 | LN794621 | 203 |
| NBGA10 | LN794632 | 197 |
| NBGA11 | LN794630 | 193 |
| NBGA12 | LN794626 | 187 |
| NBGA13 | LN794624 | 143 |
| NBGA14 | LN794628 | 140 |
| NBGA15 | LN794627 | 133 |
| NBGA16 | LN794622 | 130 |

TABLE 5

Bla g Peptides Included in Epitope Screen. (SEQ ID NOs.: 257-1833)

| Sequence | Antigen | Position | Set |
|---|---|---|---|
| NAIEFLNNIHDLLGI | Bla g 1 | 1 | Known Allergens |
| LNNIHDLLGIPHIPV | Bla g 1 | 6 | Known Allergens |
| DLLGIPHIPVTARKH | Bla g 1 | 11 | Known Allergens |
| PHIPVTARKHHRRGV | Bla g 1 | 16 | Known Allergens |
| TARKHHRRGVGITGL | Bla g 1 | 21 | Known Allergens |
| HRRGVGITGLIDDII | Bla g 1 | 26 | Known Allergens |
| GITGLIDDIIAILPV | Bla g 1 | 31 | Known Allergens |
| IDDIIAILPVDDLYA | Bla g 1 | 36 | Known Allergens |
| AILPVDDLYALFQEK | Bla g 1 | 41 | Known Allergens |
| DDLYALFQEKLETSP | Bla g 1 | 46 | Known Allergens |
| LFQEKLETSPEFKAL | Bla g 1 | 51 | Known Allergens |
| LETSPEFKALYDAIR | Bla g 1 | 56 | Known Allergens |
| EFKALYDAIRSPEFQ | Bla g 1 | 61 | Known Allergens |
| YDAIRSPEFQSIVGT | Bla g 1 | 66 | Known Allergens |
| SPEFQSIVGTLEAMP | Bla g 1 | 71 | Known Allergens |
| SIVGTLEAMPEYQNL | Bla g 1 | 76 | Known Allergens |
| LEAMPEYQNLIQKLK | Bla g 1 | 81 | Known Allergens |
| EYQNLIQKLKDKGVD | Bla g 1 | 86 | Known Allergens |
| IQKLKDKGVDVDHII | Bla g 1 | 91 | Known Allergens |
| DKGVDVDHIIELIHQ | Bla g 1 | 96 | Known Allergens |
| VDHIIELIHQIFNIV | Bla g 1 | 101 | Known Allergens |
| ELIHQIFNIVRDTRG | Bla g 1 | 106 | Known Allergens |
| IFNIVRDTRGLPEDL | Bla g 1 | 111 | Known Allergens |
| RDTRGLPEDLQDFLA | Bla g 1 | 116 | Known Allergens |

TABLE 5-continued

Bla g Peptides Included in Epitope Screen. (SEQ ID NOs.: 257-1833)

| Sequence | Antigen | Position | Set |
|---|---|---|---|
| DTRGLPEDLQDFLAL | Bla g 1 | 117 | Known Allergens |
| LPEDLQDFLALIPTD | Bla g 1 | 121 | Known Allergens |
| QDFLALIPTDQVLAI | Bla g 1 | 126 | Known Allergens |
| LIPTDQVLAIAADYL | Bla g 1 | 131 | Known Allergens |
| QVLAIAADYLANDAE | Bla g 1 | 136 | Known Allergens |
| AADYLANDAEVKAAV | Bla g 1 | 141 | Known Allergens |
| ANDAEVKAAVEYLKS | Bla g 1 | 146 | Known Allergens |
| VKAAVEYLKSDEFET | Bla g 1 | 151 | Known Allergens |
| EYLKSDEFETIVVTV | Bla g 1 | 156 | Known Allergens |
| DEFETIVVTVDSLPE | Bla g 1 | 161 | Known Allergens |
| IVVTVDSLPEFKNFL | Bla g 1 | 166 | Known Allergens |
| DSLPEFKNFLNFLQT | Bla g 1 | 171 | Known Allergens |
| FKNFLNFLQTNGLNA | Bla g 1 | 176 | Known Allergens |
| NFLQTNGLNAIEFLN | Bla g 1 | 181 | Known Allergens |
| NGLNAIEFLNNIHDL | Bla g 1 | 186 | Known Allergens |
| IEFLNNIHDLLGIPH | Bla g 1 | 191 | Known Allergens |
| NIHDLLGIPHIPVTG | Bla g 1 | 196 | Known Allergens |
| LGIPHIPVTGRKHLR | Bla g 1 | 201 | Known Allergens |
| IPVTGRKHLRRGVGI | Bla g 1 | 206 | Known Allergens |
| RKHLRRGVGITGLID | Bla g 1 | 211 | Known Allergens |
| HLRRGVGITGLIDDI | Bla g 1 | 213 | Known Allergens |
| RGVGITGLIDDIIAI | Bla g 1 | 216 | Known Allergens |
| TGLIDDIIAILPVDD | Bla g 1 | 221 | Known Allergens |
| DIIAILPVDDLYALF | Bla g 1 | 226 | Known Allergens |
| LPVDDLYALFQEKLE | Bla g 1 | 231 | Known Allergens |
| LYALFQEKLETSPEF | Bla g 1 | 236 | Known Allergens |
| QEKLETSPEFKALYD | Bla g 1 | 241 | Known Allergens |
| TSPEFKALYDAIRSP | Bla g 1 | 246 | Known Allergens |
| KALYDAIRSPEFQSI | Bla g 1 | 251 | Known Allergens |
| AIRSPEFQSIVETLK | Bla g 1 | 256 | Known Allergens |
| EFQSIVETLKAMPEY | Bla g 1 | 261 | Known Allergens |
| VETLKAMPEYQSLIQ | Bla g 1 | 266 | Known Allergens |
| AMPEYQSLIQKLKDK | Bla g 1 | 271 | Known Allergens |
| QSLIQKLKDKGVDVD | Bla g 1 | 276 | Known Allergens |
| KLKDKGVDVDHIIEL | Bla g 1 | 281 | Known Allergens |
| GVDVDHIIELIHQIF | Bla g 1 | 286 | Known Allergens |
| HIIELIHQIFNIVRD | Bla g 1 | 291 | Known Allergens |

TABLE 5-continued

Bla g Peptides Included in Epitope Screen. (SEQ ID NOs.: 257-1833)

| Sequence | Antigen | Position | Set |
|---|---|---|---|
| IHQIFNIVRDTRGLP | Bla g 1 | 296 | Known Allergens |
| NIVRDTRGLPEDLQD | Bla g 1 | 301 | Known Allergens |
| DTRGLPEDLQDFLAL | Bla g 1 | 305 | Known Allergens |
| TRGLPEDLQDFLALI | Bla g 1 | 306 | Known Allergens |
| EDLQDFLALIPIDQI | Bla g 1 | 311 | Known Allergens |
| FLALIPIDQILAIAA | Bla g 1 | 316 | Known Allergens |
| PIDQILAIAADYLAN | Bla g 1 | 321 | Known Allergens |
| LAIAADYLANDAEVQ | Bla g 1 | 326 | Known Allergens |
| DYLANDAEVQAAVEY | Bla g 1 | 331 | Known Allergens |
| DAEVQAAVEYLKSDE | Bla g 1 | 336 | Known Allergens |
| AAVEYLKSDEFETIV | Bla g 1 | 341 | Known Allergens |
| LKSDEFETIVVTVDS | Bla g 1 | 346 | Known Allergens |
| FETIVVTVDSLPEFK | Bla g 1 | 351 | Known Allergens |
| VTVDSLPEFKNFLNF | Bla g 1 | 356 | Known Allergens |
| LPEFKNFLNFLQTNG | Bla g 1 | 361 | Known Allergens |
| NFLNFLQTNGLNAIE | Bla g 1 | 366 | Known Allergens |
| LQTNGLNAIEFINNI | Bla g 1 | 371 | Known Allergens |
| LNAIEFINNIHDLLG | Bla g 1 | 376 | Known Allergens |
| FINNIHDLLGIPHIP | Bla g 1 | 381 | Known Allergens |
| HDLLGIPHIPATGRK | Bla g 1 | 386 | Known Allergens |
| IPHIPATGRKHVRRG | Bla g 1 | 391 | Known Allergens |
| ATGRKHVRRGVGING | Bla g 1 | 396 | Known Allergens |
| HVRRGVGINGLIDDV | Bla g 1 | 401 | Known Allergens |
| VGINGLIDDVIAILP | Bla g 1 | 406 | Known Allergens |
| LIDDVIAILPVDELY | Bla g 1 | 411 | Known Allergens |
| IAILPVDELYALFQE | Bla g 1 | 416 | Known Allergens |
| VDELYALFQEKLESS | Bla g 1 | 421 | Known Allergens |
| ALFQEKLESSPEFKA | Bla g 1 | 426 | Known Allergens |
| KLESSPEFKALYDAI | Bla g 1 | 431 | Known Allergens |
| PEFKALYDAIRSPEF | Bla g 1 | 436 | Known Allergens |
| LYDAIRSPEFQSIVQ | Bla g 1 | 441 | Known Allergens |
| RSPEFQSIVQTLKAM | Bla g 1 | 446 | Known Allergens |
| QSIVQTLKAMPEYQD | Bla g 1 | 451 | Known Allergens |
| TLKAMPEYQDLIQRL | Bla g 1 | 456 | Known Allergens |
| PEYQDLIQRLKDKGV | Bla g 1 | 461 | Known Allergens |
| LIQRLKDKGVDVDHF | Bla g 1 | 466 | Known Allergens |
| KDKGVDVDHFIELIK | Bla g 1 | 471 | Known Allergens |
| DVDHFIELIKKLFGL | Bla g 1 | 476 | Known Allergens |

TABLE 5-continued

Bla g Peptides Included in Epitope Screen. (SEQ ID NOs.: 257-1833)

| Sequence | Antigen | Position | Set |
|---|---|---|---|
| DHFIELIKKLFGLSH | Bla g 1 | 478 | Known Allergens |
| NLLEKLREKGVDVDK | Bla g 1.0101 | 1 | Known Allergens |
| LEKLREKGVDVDKII | Bla g 1.0101 | 3 | Known Allergens |
| EKGVDVDKIIELIRA | Bla g 1.0101 | 8 | Known Allergens |
| VDKIIELIRALFGLT | Bla g 1.0101 | 13 | Known Allergens |
| KIIELIRALFGLTLN | Bla g 1.0101 | 15 | Known Allergens |
| IRALFGLTLNAKASR | Bla g 1.0101 | 20 | Known Allergens |
| GLTLNAKASRNLQDD | Bla g 1.0101 | 25 | Known Allergens |
| AKASRNLQDDLQDFL | Bla g 1.0101 | 30 | Known Allergens |
| KASRNLQDDLQDFLA | Bla g 1.0101 | 31 | Known Allergens |
| ASRNLQDDLQDFLAL | Bla g 1.0101 | 32 | Known Allergens |
| LQDDLQDFLALIPVD | Bla g 1.0101 | 36 | Known Allergens |
| QDFLALIPVDQIIAI | Bla g 1.0101 | 41 | Known Allergens |
| LIPVDQIIAIATDYL | Bla g 1.0101 | 46 | Known Allergens |
| QIIAIATDYLANDAE | Bla g 1.0101 | 51 | Known Allergens |
| ATDYLANDAEVQAAV | Bla g 1.0101 | 56 | Known Allergens |
| ANDAEVQAAVAYLQS | Bla g 1.0101 | 61 | Known Allergens |
| VQAAVAYLQSDEFET | Bla g 1.0101 | 66 | Known Allergens |
| AYLQSDEFETIVVAL | Bla g 1.0101 | 71 | Known Allergens |
| DEFETIVVALDALPE | Bla g 1.0101 | 76 | Known Allergens |
| IVVALDALPELQNFL | Bla g 1.0101 | 81 | Known Allergens |
| DALPELQNFLNFLEA | Bla g 1.0101 | 86 | Known Allergens |
| LQNFLNFLEANGLNA | Bla g 1.0101 | 91 | Known Allergens |
| NFLEANGLNAIDFLN | Bla g 1.0101 | 96 | Known Allergens |
| NGLNAIDFLNGIHDL | Bla g 1.0101 | 101 | Known Allergens |
| IDFLNGIHDLLGIPH | Bla g 1.0101 | 106 | Known Allergens |
| GIHDLLGIPHIPVSG | Bla g 1.0101 | 111 | Known Allergens |
| DLLGIPHIPVSGRKY | Bla g 1.0101 | 114 | Known Allergens |
| PHIPVSGRKYHIRRG | Bla g 1.0101 | 119 | Known Allergens |
| SGRKYHIRRGVGITG | Bla g 1.0101 | 124 | Known Allergens |
| YHIRRGVGITGLIDD | Bla g 1.0101 | 128 | Known Allergens |
| HIRRGVGITGLIDDV | Bla g 1.0101 | 129 | Known Allergens |
| RGVGITGLIDDVLAI | Bla g 1.0101 | 132 | Known Allergens |
| TGLIDDVLAILPIED | Bla g 1.0101 | 137 | Known Allergens |
| DVLAILPIEDLKALF | Bla g 1.0101 | 142 | Known Allergens |
| LPIEDLKALFNEKLE | Bla g 1.0101 | 147 | Known Allergens |
| LKALFNEKLETSPDF | Bla g 1.0101 | 152 | Known Allergens |

TABLE 5-continued

Bla g Peptides Included in Epitope Screen. (SEQ ID NOs.: 257-1833)

| Sequence | Antigen | Position | Set |
|---|---|---|---|
| NEKLETSPDFLALYN | Bla g 1.0101 | 157 | Known Allergens |
| TSPDFLALYNAIRSP | Bla g 1.0101 | 162 | Known Allergens |
| LALYNAIRSPEFQSI | Bla g 1.0101 | 167 | Known Allergens |
| AIRSPEFQSIVQTLN | Bla g 1.0101 | 172 | Known Allergens |
| EFQSIVQTLNAMPEY | Bla g 1.0101 | 177 | Known Allergens |
| VQTLNAMPEYQNLLQ | Bla g 1.0101 | 182 | Known Allergens |
| AMPEYQNLLQKLREK | Bla g 1.0101 | 187 | Known Allergens |
| QNLLQKLREKGVDVD | Bla g 1.0101 | 192 | Known Allergens |
| KLREKGVDVDKIIEL | Bla g 1.0101 | 197 | Known Allergens |
| GVDVDKIIELIRALF | Bla g 1.0101 | 202 | Known Allergens |
| KIIELIRALFGLTLN | Bla g 1.0101 | 207 | Known Allergens |
| IRALFGLTLNGKASR | Bla g 1.0101 | 212 | Known Allergens |
| GLTLNGKASRNLQDD | Bla g 1.0101 | 217 | Known Allergens |
| LNGKASRNLQDDLQD | Bla g 1.0101 | 220 | Known Allergens |
| GKASRNLQDDLQDFL | Bla g 1.0101 | 222 | Known Allergens |
| KASRNLQDDLQDFLA | Bla g 1.0101 | 223 | Known Allergens |
| ASRNLQDDLQDFLAL | Bla g 1.0101 | 224 | Known Allergens |
| SRNLQDDLQDFLALI | Bla g 1.0101 | 225 | Known Allergens |
| DDLQDFLALIPVDQI | Bla g 1.0101 | 230 | Known Allergens |
| FLALIPVDQIIAIAT | Bla g 1.0101 | 235 | Known Allergens |
| PVDQIIAIATDYLAN | Bla g 1.0101 | 240 | Known Allergens |
| IAIATDYLANDAEVQ | Bla g 1.0101 | 245 | Known Allergens |
| DYLANDAEVQAAVAY | Bla g 1.0101 | 250 | Known Allergens |
| DAEVQAAVAYLQSDE | Bla g 1.0101 | 255 | Known Allergens |
| AAVAYLQSDEFETIV | Bla g 1.0101 | 260 | Known Allergens |
| LQSDEFETIVVTLDA | Bla g 1.0101 | 265 | Known Allergens |
| FETIVVTLDALPELQ | Bla g 1.0101 | 270 | Known Allergens |
| VTLDALPELQNFLNF | Bla g 1.0101 | 275 | Known Allergens |
| LPELQNFLNFLEANG | Bla g 1.0101 | 280 | Known Allergens |
| NFLNFLEANGLNAID | Bla g 1.0101 | 285 | Known Allergens |
| LEANGLNAIDFLNGI | Bla g 1.0101 | 290 | Known Allergens |
| LNAIDFLNGIHDLLG | Bla g 1.0101 | 295 | Known Allergens |
| FLNGIHDLLGIPHIP | Bla g 1.0101 | 300 | Known Allergens |
| HDLLGIPHIPVSGRK | Bla g 1.0101 | 305 | Known Allergens |
| IPHIPVSGRKYHIRR | Bla g 1.0101 | 310 | Known Allergens |
| VSGRKYHIRRGVGIT | Bla g 1.0101 | 315 | Known Allergens |
| HIRRGVGITGLIDDV | Bla g 1.0101 | 321 | Known Allergens |
| VGITGLIDDVLAILP | Bla g 1.0101 | 326 | Known Allergens |

TABLE 5-continued

Bla g Peptides Included in Epitope Screen. (SEQ ID NOs.: 257-1833)

| Sequence | Antigen | Position | Set |
|---|---|---|---|
| LIDDVLAILPLDDLK | Bla g 1.0101 | 331 | Known Allergens |
| LAILPLDDLKALFNE | Bla g 1.0101 | 336 | Known Allergens |
| LDDLKALFNEKLETS | Bla g 1.0101 | 341 | Known Allergens |
| ALFNEKLETSPDFLA | Bla g 1.0101 | 346 | Known Allergens |
| KLETSPDFLALYNAI | Bla g 1.0101 | 351 | Known Allergens |
| PDFLALYNAIKSPEF | Bla g 1.0101 | 356 | Known Allergens |
| LYNAIKSPEFQSIVQ | Bla g 1.0101 | 361 | Known Allergens |
| KSPEFQSIVQTLNAM | Bla g 1.0101 | 366 | Known Allergens |
| QSIVQTLNAMPEYQN | Bla g 1.0101 | 371 | Known Allergens |
| TLNAMPEYQNLLEKL | Bla g 1.0101 | 376 | Known Allergens |
| PEYQNLLEKLREKGV | Bla g 1.0101 | 381 | Known Allergens |
| LLEKLREKGVDVDKI | Bla g 1.0101 | 386 | Known Allergens |
| REKGVDVDKIIELIR | Bla g 1.0101 | 391 | Known Allergens |
| DVDKIIELIRALFGL | Bla g 1.0101 | 396 | Known Allergens |
| DKIIELIRALFGLTH | Bla g 1.0101 | 398 | Known Allergens |
| SQKDPHVWDGRSAIV | Bla g 11 | 18 | Known Allergens |
| HLFEWKFADIADECE | Bla g 11 | 33 | Known Allergens |
| KFADIADECERFLGP | Bla g 11 | 38 | Known Allergens |
| ADECERFLGPKGFAG | Bla g 11 | 43 | Known Allergens |
| RFLGPKGFAGVQVSP | Bla g 11 | 48 | Known Allergens |
| VQVSPVHENVIISSP | Bla g 11 | 58 | Known Allergens |
| IISSPFRPWWERYQL | Bla g 11 | 68 | Known Allergens |
| VSYKLVSRSGDENAF | Bla g 11 | 83 | Known Allergens |
| VSRSGDENAFRDMVR | Bla g 11 | 88 | Known Allergens |
| DENAFRDMVRRCNNV | Bla g 11 | 93 | Known Allergens |
| NQMSGSWPDAHGQGG | Bla g 11 | 118 | Known Allergens |
| SWPDAHGQGGSTADT | Bla g 11 | 123 | Known Allergens |
| HGQGGSTADTYNLQY | Bla g 11 | 128 | Known Allergens |
| STADTYNLQYPAVPY | Bla g 11 | 133 | Known Allergens |
| YNLQYPAVPYGPGDF | Bla g 11 | 138 | Known Allergens |
| PAVPYGPGDFHSTCT | Bla g 11 | 143 | Known Allergens |
| GPGDFHSTCTVSNYQ | Bla g 11 | 148 | Known Allergens |
| HSTCTVSNYQDPSNV | Bla g 11 | 153 | Known Allergens |
| VSNYQDPSNVRNCEL | Bla g 11 | 158 | Known Allergens |
| DPSNVRNCELVGLHD | Bla g 11 | 163 | Known Allergens |
| RNCELVGLHDLNQGS | Bla g 11 | 168 | Known Allergens |
| VGLHDLNQGSDYVRG | Bla g 11 | 173 | Known Allergens |

TABLE 5-continued

Bla g Peptides Included in Epitope Screen. (SEQ ID NOs.: 257-1833)

| Sequence | Antigen | Position | Set |
|---|---|---|---|
| LNHLVDCGVAGFRVD | Bla g 11 | 193 | Known Allergens |
| AAKHMWPADLQYIYS | Bla g 11 | 208 | Known Allergens |
| WPADLQYIYSKVNNL | Bla g 11 | 213 | Known Allergens |
| QYIYSKVNNLNTDHG | Bla g 11 | 218 | Known Allergens |
| KVNNLNTDHGFPSGA | Bla g 11 | 223 | Known Allergens |
| NTDHGFPSGARPFFY | Bla g 11 | 228 | Known Allergens |
| FPSGARPFFYQEVID | Bla g 11 | 233 | Known Allergens |
| RPFFYQEVIDLGGEA | Bla g 11 | 238 | Known Allergens |
| QEVIDLGGEAIHSTE | Bla g 11 | 243 | Known Allergens |
| LGGEAIHSTEYTGFG | Bla g 11 | 248 | Known Allergens |
| IHSTEYTGFGRVTEF | Bla g 11 | 253 | Known Allergens |
| YTGFGRVTEFKYSRD | Bla g 11 | 258 | Known Allergens |
| RVTEFKYSRDIGDAF | Bla g 11 | 263 | Known Allergens |
| KYSRDIGDAFRGNNA | Bla g 11 | 268 | Known Allergens |
| IGDAFRGNNAIKWLV | Bla g 11 | 273 | Known Allergens |
| RGNNAIKWLVNFGVG | Bla g 11 | 278 | Known Allergens |
| IKWLVNFGVGWGYIP | Bla g 11 | 283 | Known Allergens |
| NFGVGWGYIPDGDAL | Bla g 11 | 288 | Known Allergens |
| WGYIPDGDALVFVDN | Bla g 11 | 293 | Known Allergens |
| DGDALVFVDNHDNQR | Bla g 11 | 298 | Known Allergens |
| VFVDNHDNQRGHGAG | Bla g 11 | 303 | Known Allergens |
| HDNQRGHGAGGASIL | Bla g 11 | 308 | Known Allergens |
| GHGAGGASILTYKTS | Bla g 11 | 313 | Known Allergens |
| GASILTYKTSKLYKM | Bla g 11 | 318 | Known Allergens |
| TYKTSKLYKMAVAFM | Bla g 11 | 323 | Known Allergens |
| KLYKMAVAFMLAYPY | Bla g 11 | 328 | Known Allergens |
| AVAFMLAYPYGYPRV | Bla g 11 | 333 | Known Allergens |
| LAYPYGYPRVMSSFS | Bla g 11 | 338 | Known Allergens |
| GYPRVMSSFSFDNSD | Bla g 11 | 343 | Known Allergens |
| MSSFSFDNSDQGPPQ | Bla g 11 | 348 | Known Allergens |
| FDNSDQGPPQDGNGN | Bla g 11 | 353 | Known Allergens |
| QGPPQDGNGNIISPS | Bla g 11 | 358 | Known Allergens |
| DGNGNIISPSINADG | Bla g 11 | 363 | Known Allergens |
| IISPSINADGTCGNG | Bla g 11 | 368 | Known Allergens |
| INADGTCGNGWVCEH | Bla g 11 | 373 | Known Allergens |
| TCGNGWVCEHRWRQI | Bla g 11 | 378 | Known Allergens |
| WVCEHRWRQIFNMVG | Bla g 11 | 383 | Known Allergens |
| RWRQIFNMVGFRNAV | Bla g 11 | 388 | Known Allergens |

TABLE 5-continued

Bla g Peptides Included in Epitope Screen. (SEQ ID NOs.: 257-1833)

| Sequence | Antigen | Position | Set |
|---|---|---|---|
| FNMVGFRNAVAGTAV | Bla g 11 | 393 | Known Allergens |
| FRNAVAGTAVSNWWD | Bla g 11 | 398 | Known Allergens |
| AGTAVSNWWDNGDKQ | Bla g 11 | 403 | Known Allergens |
| SNWWDNGDKQISFCR | Bla g 11 | 408 | Known Allergens |
| NGDKQISFCRGNKGF | Bla g 11 | 413 | Known Allergens |
| ISFCRGNKGFVAFND | Bla g 11 | 418 | Known Allergens |
| GNKGFVAFNDEFNND | Bla g 11 | 423 | Known Allergens |
| VAFNDEFNNDLKQTL | Bla g 11 | 428 | Known Allergens |
| EFNNDLKQTLQTCLP | Bla g 11 | 433 | Known Allergens |
| LKQTLQTCLPAGDYC | Bla g 11 | 438 | Known Allergens |
| QTCLPAGDYCDVISG | Bla g 11 | 443 | Known Allergens |
| AGDYCDVISGSYENG | Bla g 11 | 448 | Known Allergens |
| DVISGSYENGSCTGK | Bla g 11 | 453 | Known Allergens |
| SYENGSCTGKTVTVG | Bla g 11 | 458 | Known Allergens |
| SCTGKTVTVGSDGKA | Bla g 11 | 463 | Known Allergens |
| TVTVGSDGKAYIEIL | Bla g 11 | 468 | Known Allergens |
| SDGKAYIEILSSADD | Bla g 11 | 473 | Known Allergens |
| YIEILSSADDGVLAI | Bla g 11 | 478 | Known Allergens |
| SSADDGVLAIHVNSK | Bla g 11 | 483 | Known Allergens |
| GVLAIHVNSKVGSKS | Bla g 11 | 488 | Known Allergens |
| HVNSKVGSKSQTTTT | Bla g 11 | 493 | Known Allergens |
| VGSKSQTTTTQSSHC | Bla g 11 | 498 | Known Allergens |
| KSQTTTTQSSHCTCS | Bla g 11 | 503 | Known Allergens |
| MIGLKLVTVLFAVAT | Bla g 2 | 1 | Known Allergens |
| LVTVLFAVATITHAA | Bla g 2 | 6 | Known Allergens |
| FAVATITHAAELQRV | Bla g 2 | 11 | Known Allergens |
| ITHAAELQRVPLYKL | Bla g 2 | 16 | Known Allergens |
| ELQRVPLYKLVHVFI | Bla g 2 | 21 | Known Allergens |
| PLYKLVHVFINTQYA | Bla g 2 | 26 | Known Allergens |
| VHVFINTQYAGITKI | Bla g 2 | 31 | Known Allergens |
| NTQYAGITKIGNQNF | Bla g 2 | 36 | Known Allergens |
| GITKIGNQNFLTVFD | Bla g 2 | 41 | Known Allergens |
| GNQNFLTVFDSTSCN | Bla g 2 | 46 | Known Allergens |
| LTVFDSTSCNVVAS | Bla g 2 | 51 | Known Allergens |
| STSCNVVASQECVG | Bla g 2 | 56 | Known Allergens |
| VVASQECVGGACVC | Bla g 2 | 61 | Known Allergens |
| QECVGGACVCPNLQK | Bla g 2 | 66 | Known Allergens |

TABLE 5-continued

Bla g Peptides Included in Epitope Screen. (SEQ ID NOs.: 257-1833)

| Sequence | Antigen | Position | Set |
|---|---|---|---|
| GACVCPNLQKYEKLK | Bla g 2 | 71 | Known Allergens |
| PNLQKYEKLKPKYIS | Bla g 2 | 76 | Known Allergens |
| YEKLKPKYISDGNVQ | Bla g 2 | 81 | Known Allergens |
| PKYISDGNVQVKFFD | Bla g 2 | 86 | Known Allergens |
| DGNVQVKFFDTGSAV | Bla g 2 | 91 | Known Allergens |
| VKFFDTGSAVGRGIE | Bla g 2 | 96 | Known Allergens |
| TGSAVGRGIEDSLTI | Bla g 2 | 101 | Known Allergens |
| GRGIEDSLTISNLTT | Bla g 2 | 106 | Known Allergens |
| DSLTISNLTTSQQDI | Bla g 2 | 111 | Known Allergens |
| SNLTTSQQDIVLADE | Bla g 2 | 116 | Known Allergens |
| SQQDIVLADELSQEV | Bla g 2 | 121 | Known Allergens |
| VLADELSQEVCILSA | Bla g 2 | 126 | Known Allergens |
| LSQEVCILSADVVVG | Bla g 2 | 131 | Known Allergens |
| CILSADVVVGIAAPG | Bla g 2 | 136 | Known Allergens |
| DVVVGIAAPGCPNAL | Bla g 2 | 141 | Known Allergens |
| IAAPGCPNALKGKTV | Bla g 2 | 146 | Known Allergens |
| CPNALKGKTVLENFV | Bla g 2 | 151 | Known Allergens |
| KGKTVLENFVEENLI | Bla g 2 | 156 | Known Allergens |
| LENFVEENLIAPVFS | Bla g 2 | 161 | Known Allergens |
| EENLIAPVFSIHHAR | Bla g 2 | 166 | Known Allergens |
| APVFSIHHARFQDGE | Bla g 2 | 171 | Known Allergens |
| IHHARFQDGEHFGEI | Bla g 2 | 176 | Known Allergens |
| FQDGEHFGEIIFGGS | Bla g 2 | 181 | Known Allergens |
| HFGEIIFGGSDWKYV | Bla g 2 | 186 | Known Allergens |
| IFGGSDWKYVDGEFT | Bla g 2 | 191 | Known Allergens |
| DWKYVDGEFTYVPLV | Bla g 2 | 196 | Known Allergens |
| DGEFTYVPLVGDDSW | Bla g 2 | 201 | Known Allergens |
| YVPLVGDDSWKFRLD | Bla g 2 | 206 | Known Allergens |
| GDDSWKFRLDGVKIG | Bla g 2 | 211 | Known Allergens |
| KFRLDGVKIGDTTVA | Bla g 2 | 216 | Known Allergens |
| GVKIGDTTVAPAGTQ | Bla g 2 | 221 | Known Allergens |
| DTTVAPAGTQAIIDT | Bla g 2 | 226 | Known Allergens |
| PAGTQAIIDTSKAII | Bla g 2 | 231 | Known Allergens |
| AIIDTSKAIIVGPKA | Bla g 2 | 236 | Known Allergens |
| SKAIIVGPKAYVNPI | Bla g 2 | 241 | Known Allergens |
| VGPKAYVNPINEAIG | Bla g 2 | 246 | Known Allergens |
| YVNPINEAIGCVVEK | Bla g 2 | 251 | Known Allergens |
| NEAIGCVVEKTTTRR | Bla g 2 | 256 | Known Allergens |

TABLE 5-continued

Bla g Peptides Included in Epitope Screen. (SEQ ID NOs.: 257-1833)

| Sequence | Antigen | Position | Set |
|---|---|---|---|
| CVVEKTTTRRICKLD | Bla g 2 | 261 | Known Allergens |
| TTTRRICKLDCSKIP | Bla g 2 | 266 | Known Allergens |
| ICKLDCSKIPSLPDV | Bla g 2 | 271 | Known Allergens |
| CSKIPSLPDVTFVIN | Bla g 2 | 276 | Known Allergens |
| SLPDVTFVINGRNFN | Bla g 2 | 281 | Known Allergens |
| TFVINGRNFNISSQY | Bla g 2 | 286 | Known Allergens |
| GRNFNISSQYYIQQN | Bla g 2 | 291 | Known Allergens |
| ISSQYYIQQNGNLCY | Bla g 2 | 296 | Known Allergens |
| YIQQNGNLCYSGFQP | Bla g 2 | 301 | Known Allergens |
| GNLCYSGFQPCGHSD | Bla g 2 | 306 | Known Allergens |
| SGFQPCGHSDHFFIG | Bla g 2 | 311 | Known Allergens |
| CGHSDHFFIGDFFVD | Bla g 2 | 316 | Known Allergens |
| HFFIGDFFVDHYYSE | Bla g 2 | 321 | Known Allergens |
| DFFVDHYYSEFNWEN | Bla g 2 | 326 | Known Allergens |
| HYYSEFNWENKTMGF | Bla g 2 | 331 | Known Allergens |
| FNWENKTMGFGRSVE | Bla g 2 | 336 | Known Allergens |
| WENKTMGFGRSVESV | Bla g 2 | 338 | Known Allergens |
| AVLALCATDTLANED | Bla g 4 | 1 | Known Allergens |
| CATDTLANEDCFRHE | Bla g 4 | 6 | Known Allergens |
| LANEDCFRHESLVPN | Bla g 4 | 11 | Known Allergens |
| CFRHESLVPNLDYER | Bla g 4 | 16 | Known Allergens |
| SLVPNLDYERFRGSW | Bla g 4 | 21 | Known Allergens |
| LDYERFRGSWIIAAG | Bla g 4 | 26 | Known Allergens |
| FRGSWIIAAGTSEAL | Bla g 4 | 31 | Known Allergens |
| IIAAGTSEALTQYKC | Bla g 4 | 36 | Known Allergens |
| TSEALTQYKCWIDRF | Bla g 4 | 41 | Known Allergens |
| TQYKCWIDRFSYDDA | Bla g 4 | 46 | Known Allergens |
| WIDRFSYDDALVSKY | Bla g 4 | 51 | Known Allergens |
| SYDDALVSKYTDSQG | Bla g 4 | 56 | Known Allergens |
| LVSKYTDSQGKNRTT | Bla g 4 | 61 | Known Allergens |
| TDSQGKNRTTIRGRT | Bla g 4 | 66 | Known Allergens |
| KNRTTIRGRTKFEGN | Bla g 4 | 71 | Known Allergens |
| IRGRTKFEGNKFTID | Bla g 4 | 76 | Known Allergens |
| KFEGNKFTIDYNDKG | Bla g 4 | 81 | Known Allergens |
| KFTIDYNDKGKAFSA | Bla g 4 | 86 | Known Allergens |
| YNDKGKAFSAPYSVL | Bla g 4 | 91 | Known Allergens |
| KAFSAPYSVLATDYE | Bla g 4 | 96 | Known Allergens |

TABLE 5-continued

Bla g Peptides Included in Epitope Screen. (SEQ ID NOs.: 257-1833)

| Sequence | Antigen | Position | Set |
|---|---|---|---|
| PYSVLATDYENYAIV | Bla g 4 | 101 | Known Allergens |
| ATDYENYAIVEGCPA | Bla g 4 | 106 | Known Allergens |
| NYAIVEGCPAAANGH | Bla g 4 | 111 | Known Allergens |
| EGCPAAANGHVIYVQ | Bla g 4 | 116 | Known Allergens |
| AANGHVIYVQIRFSV | Bla g 4 | 121 | Known Allergens |
| VIYVQIRFSVRRFHP | Bla g 4 | 126 | Known Allergens |
| IRFSVRRFHPKLGDK | Bla g 4 | 131 | Known Allergens |
| RRFHPKLGDKEMIQH | Bla g 4 | 136 | Known Allergens |
| KLGDKEMIQHYTLDQ | Bla g 4 | 141 | Known Allergens |
| EMIQHYTLDQVNQHK | Bla g 4 | 146 | Known Allergens |
| YTLDQVNQHKKAIEE | Bla g 4 | 151 | Known Allergens |
| VNQHKKAIEEDLKHF | Bla g 4 | 156 | Known Allergens |
| KAIEEDLKHFNLKYE | Bla g 4 | 161 | Known Allergens |
| DLKHFNLKYEDLHST | Bla g 4 | 166 | Known Allergens |
| KHFNLKYEDLHSTCH | Bla g 4 | 168 | Known Allergens |
| MAPSYKLTYCPVKAL | Bla g 5 | 1 | Known Allergens |
| KLTYCPVKALGEPIR | Bla g 5 | 6 | Known Allergens |
| PVKALGEPIRFLLSY | Bla g 5 | 11 | Known Allergens |
| GEPIRFLLSYGEKDF | Bla g 5 | 16 | Known Allergens |
| FLLSYGEKDFEDYRF | Bla g 5 | 21 | Known Allergens |
| GEKDFEDYRFQEGDW | Bla g 5 | 26 | Known Allergens |
| EDYRFQEGDWPNLKP | Bla g 5 | 31 | Known Allergens |
| QEGDWPNLKPSMPFG | Bla g 5 | 36 | Known Allergens |
| PNLKPSMPFGKTPVL | Bla g 5 | 41 | Known Allergens |
| SMPFGKTPVLEIDGK | Bla g 5 | 46 | Known Allergens |
| KTPVLEIDGKQTHQS | Bla g 5 | 51 | Known Allergens |
| EIDGKQTHQSVAISR | Bla g 5 | 56 | Known Allergens |
| QTHQSVAISRYLGKQ | Bla g 5 | 61 | Known Allergens |
| VAISRYLGKQFGLSG | Bla g 5 | 66 | Known Allergens |
| YLGKQFGLSGKDDWE | Bla g 5 | 71 | Known Allergens |
| FGLSGKDDWENLEID | Bla g 5 | 76 | Known Allergens |
| KDDWENLEIDMIVDT | Bla g 5 | 81 | Known Allergens |
| NLEIDMIVDTISDFR | Bla g 5 | 86 | Known Allergens |
| MIVDTISDFRAAIAN | Bla g 5 | 91 | Known Allergens |
| ISDFRAAIANYHYDA | Bla g 5 | 96 | Known Allergens |
| AAIANYHYDADENSK | Bla g 5 | 101 | Known Allergens |
| YHYDADENSKQKKWD | Bla g 5 | 106 | Known Allergens |
| DENSKQKKWDPLKKE | Bla g 5 | 111 | Known Allergens |

TABLE 5-continued

Bla g Peptides Included in Epitope Screen. (SEQ ID NOs.: 257-1833)

| Sequence | Antigen | Position | Set |
|---|---|---|---|
| QKKWDPLKKETIPYY | Bla g 5 | 116 | Known Allergens |
| PLKKETIPYYTKKFD | Bla g 5 | 121 | Known Allergens |
| TIPYYTKKFDEVVKA | Bla g 5 | 126 | Known Allergens |
| TKKFDEVVKANGGYL | Bla g 5 | 131 | Known Allergens |
| EVVKANGGYLAAGKL | Bla g 5 | 136 | Known Allergens |
| NGGYLAAGKLTWADF | Bla g 5 | 141 | Known Allergens |
| AAGKLTWADFYFVAI | Bla g 5 | 146 | Known Allergens |
| TWADFYFVAILDYLN | Bla g 5 | 151 | Known Allergens |
| YFVAILDYLNHMAKE | Bla g 5 | 156 | Known Allergens |
| LDYLNHMAKEDLVAN | Bla g 5 | 161 | Known Allergens |
| HMAKEDLVANQPNLK | Bla g 5 | 166 | Known Allergens |
| DLVANQPNLKALREK | Bla g 5 | 171 | Known Allergens |
| QPNLKALREKVLGLP | Bla g 5 | 176 | Known Allergens |
| ALREKVLGLPAIKAW | Bla g 5 | 181 | Known Allergens |
| VLGLPAIKAWVAKRP | Bla g 5 | 186 | Known Allergens |
| PAIKAWVAKRPPTDL | Bla g 5 | 190 | Known Allergens |
| MADEQLQLPPEQISV | Bla g 6 | 1 | Known Allergens |
| LQLPPEQISVLRKAF | Bla g 6 | 6 | Known Allergens |
| EQISVLRKAFDAFDR | Bla g 6 | 11 | Known Allergens |
| LRKAFDAFDREKSGS | Bla g 6 | 16 | Known Allergens |
| DAFDREKSGSISTNM | Bla g 6 | 21 | Known Allergens |
| EKSGSISTNMVEEIL | Bla g 6 | 26 | Known Allergens |
| ISTNMVEEILRLMGQ | Bla g 6 | 31 | Known Allergens |
| VEEILRLMGQPFNRR | Bla g 6 | 36 | Known Allergens |
| RLMGQPFNRRTLEEL | Bla g 6 | 41 | Known Allergens |
| PFNRRTLEELIDEVD | Bla g 6 | 46 | Known Allergens |
| TLEELIDEVDADKSG | Bla g 6 | 51 | Known Allergens |
| IDEVDADKSGRLEFD | Bla g 6 | 56 | Known Allergens |
| ADKSGRLEFDEFVTL | Bla g 6 | 61 | Known Allergens |
| RLEFDEFVTLAAKFI | Bla g 6 | 66 | Known Allergens |
| EFVTLAAKFIIEEDS | Bla g 6 | 71 | Known Allergens |
| AAKFIIEEDSEAMEK | Bla g 6 | 76 | Known Allergens |
| IEEDSEAMEKELREA | Bla g 6 | 81 | Known Allergens |
| EAMEKELREAFRLYD | Bla g 6 | 86 | Known Allergens |
| ELREAFRLYDKEGNG | Bla g 6 | 91 | Known Allergens |
| FRLYDKEGNGYIPTS | Bla g 6 | 96 | Known Allergens |
| KEGNGYIPTSCLREI | Bla g 6 | 101 | Known Allergens |

TABLE 5-continued

Bla g Peptides Included in Epitope Screen. (SEQ ID NOs.: 257-1833)

| Sequence | Antigen | Position | Set |
|---|---|---|---|
| YIPTSCLREILRELD | Bla g 6 | 106 | Known Allergens |
| CLREILRELDEQLTS | Bla g 6 | 111 | Known Allergens |
| LRELDEQLTSDELDM | Bla g 6 | 116 | Known Allergens |
| EQLTSDELDMMIEEI | Bla g 6 | 121 | Known Allergens |
| DELDMMIEEIDADGS | Bla g 6 | 126 | Known Allergens |
| MIEEIDADGSGTVDF | Bla g 6 | 131 | Known Allergens |
| DADGSGTVDFDEFME | Bla g 6 | 136 | Known Allergens |
| SGTVDFDEFMEMMTG | Bla g 6 | 140 | Known Allergens |
| MDEIPAEQVVLLKKA | Bla g 6.0101 | 1 | Known Allergens |
| DEIPAEQVVLLKKAF | Bla g 6.0101 | 2 | Known Allergens |
| EQVVLLKKAFDAFDR | Bla g 6.0101 | 7 | Known Allergens |
| LKKAFDAFDREKKGC | Bla g 6.0101 | 12 | Known Allergens |
| DAFDREKKGCISTEM | Bla g 6.0101 | 17 | Known Allergens |
| EKKGCISTEMVGTIL | Bla g 6.0101 | 22 | Known Allergens |
| ISTEMVGTILEMLGT | Bla g 6.0101 | 27 | Known Allergens |
| VGTILEMLGTRLDQD | Bla g 6.0101 | 32 | Known Allergens |
| EMLGTRLDQDMLDEI | Bla g 6.0101 | 37 | Known Allergens |
| RLDQDMLDEIIAEVD | Bla g 6.0101 | 42 | Known Allergens |
| MLDEIIAEVDADGSG | Bla g 6.0101 | 47 | Known Allergens |
| IAEVDADGSGELEFE | Bla g 6.0101 | 52 | Known Allergens |
| ADGSGELEFEEFCTL | Bla g 6.0101 | 57 | Known Allergens |
| ELEFEEFCTLASRFL | Bla g 6.0101 | 62 | Known Allergens |
| EFCTLASRFLVEEDA | Bla g 6.0101 | 67 | Known Allergens |
| ASRFLVEEDAEAMQH | Bla g 6.0101 | 72 | Known Allergens |
| VEEDAEAMQHELREA | Bla g 6.0101 | 77 | Known Allergens |
| EAMQHELREAFRLYD | Bla g 6.0101 | 82 | Known Allergens |
| ELREAFRLYDKEGNG | Bla g 6.0101 | 87 | Known Allergens |
| FRLYDKEGNGYITTA | Bla g 6.0101 | 92 | Known Allergens |
| KEGNGYITTAVLREI | Bla g 6.0101 | 97 | Known Allergens |
| YITTAVLREILKELD | Bla g 6.0101 | 102 | Known Allergens |
| VLREILKELDDKITA | Bla g 6.0101 | 107 | Known Allergens |
| LKELDDKITAEDLDM | Bla g 6.0101 | 112 | Known Allergens |
| DKITAEDLDMMIEEI | Bla g 6.0101 | 117 | Known Allergens |
| EDLDMMIEEIDSDGS | Bla g 6.0101 | 122 | Known Allergens |
| MIEEIDSDGSGTVDF | Bla g 6.0101 | 127 | Known Allergens |
| DSDGSGTVDFDEFME | Bla g 6.0101 | 132 | Known Allergens |
| SGTVDFDEFMEVMTG | Bla g 6.0101 | 136 | Known Allergens |
| GTVDFDEFMEVMTGE | Bla g 6.0101 | 137 | Known Allergens |

TABLE 5-continued

Bla g Peptides Included in Epitope Screen. (SEQ ID NOs.: 257-1833)

| Sequence | Antigen | Position | Set |
|---|---|---|---|
| MDELPPEQIQLLKKA | Bla g 6.0201 | 1 | Known Allergens |
| DELPPEQIQLLKKAF | Bla g 6.0201 | 2 | Known Allergens |
| EQIQLLKKAFDAFDR | Bla g 6.0201 | 7 | Known Allergens |
| ISTEMVGTILEMLGH | Bla g 6.0201 | 27 | Known Allergens |
| VGTILEMLGHRLDDD | Bla g 6.0201 | 32 | Known Allergens |
| EMLGHRLDDDMLQEI | Bla g 6.0201 | 37 | Known Allergens |
| RLDDDMLQEIIAEVD | Bla g 6.0201 | 42 | Known Allergens |
| MLQEIIAEVDADGSG | Bla g 6.0201 | 47 | Known Allergens |
| ADGSGELEFEEFVSL | Bla g 6.0201 | 57 | Known Allergens |
| ELEFEEFVSLASRFL | Bla g 6.0201 | 62 | Known Allergens |
| EFVSLASRFLVEEDA | Bla g 6.0201 | 67 | Known Allergens |
| ASRFLVEEDAEAMQQ | Bla g 6.0201 | 72 | Known Allergens |
| VEEDAEAMQQELREA | Bla g 6.0201 | 77 | Known Allergens |
| EAMQQELREAFRLYD | Bla g 6.0201 | 82 | Known Allergens |
| FRLYDKEGNGYITTN | Bla g 6.0201 | 92 | Known Allergens |
| KEGNGYITTNVLREI | Bla g 6.0201 | 97 | Known Allergens |
| YITTNVLREILKELD | Bla g 6.0201 | 102 | Known Allergens |
| MDAIKKKMQAMKLEK | Bla g 7 | 1 | Known Allergens |
| KKMQAMKLEKDNAMD | Bla g 7 | 6 | Known Allergens |
| MKLEKDNAMDRALLC | Bla g 7 | 11 | Known Allergens |
| DNAMDRALLCEQQAR | Bla g 7 | 16 | Known Allergens |
| RALLCEQQARDANIR | Bla g 7 | 21 | Known Allergens |
| EQQARDANIRAEKAE | Bla g 7 | 26 | Known Allergens |
| DANIRAEKAEEEARS | Bla g 7 | 31 | Known Allergens |
| AEKAEEEARSLQKKI | Bla g 7 | 36 | Known Allergens |
| EEARSLQKKIQQIEN | Bla g 7 | 41 | Known Allergens |
| LQKKIQQIENDLDQT | Bla g 7 | 46 | Known Allergens |
| QQIENDLDQTMEQLM | Bla g 7 | 51 | Known Allergens |
| DLDQTMEQLMQVNAK | Bla g 7 | 56 | Known Allergens |
| MEQLMQVNAKLDEKD | Bla g 7 | 61 | Known Allergens |
| QVNAKLDEKDKALQN | Bla g 7 | 66 | Known Allergens |
| LDEKDKALQNAESEV | Bla g 7 | 71 | Known Allergens |
| KALQNAESEVAALNR | Bla g 7 | 76 | Known Allergens |
| AESEVAALNRRIQLL | Bla g 7 | 81 | Known Allergens |
| AALNRRIQLLEEDLE | Bla g 7 | 86 | Known Allergens |
| RIQLLEEDLERSEER | Bla g 7 | 91 | Known Allergens |
| EEDLERSEERLATAT | Bla g 7 | 96 | Known Allergens |

TABLE 5-continued

Bla g Peptides Included in Epitope Screen. (SEQ ID NOs.: 257-1833)

| Sequence | Antigen | Position | Set |
|---|---|---|---|
| RSEERLATATAKLAE | Bla g 7 | 101 | Known Allergens |
| LATATAKLAEASQAA | Bla g 7 | 106 | Known Allergens |
| AKLAEASQAADESER | Bla g 7 | 111 | Known Allergens |
| ASQAADESERARKIL | Bla g 7 | 116 | Known Allergens |
| DESERARKILESKGL | Bla g 7 | 121 | Known Allergens |
| ARKILESKGLADEER | Bla g 7 | 126 | Known Allergens |
| ESKGLADEERMDALE | Bla g 7 | 131 | Known Allergens |
| ADEERMDALENQLKE | Bla g 7 | 136 | Known Allergens |
| MDALENQLKEARFMA | Bla g 7 | 141 | Known Allergens |
| NQLKEARFMAEEADK | Bla g 7 | 146 | Known Allergens |
| ARFMAEEADKKYDEV | Bla g 7 | 151 | Known Allergens |
| EEADKKYDEVARKLA | Bla g 7 | 156 | Known Allergens |
| KYDEVARKLAMVEAD | Bla g 7 | 161 | Known Allergens |
| ARKLAMVEADLERAE | Bla g 7 | 166 | Known Allergens |
| MVEADLERAEERAET | Bla g 7 | 171 | Known Allergens |
| LERAEERAETGESKI | Bla g 7 | 176 | Known Allergens |
| ERAETGESKIVELEE | Bla g 7 | 181 | Known Allergens |
| GESKIVELEEELRVV | Bla g 7 | 186 | Known Allergens |
| VELEEELRVVGNNLK | Bla g 7 | 191 | Known Allergens |
| ELRVVGNNLKSLEVS | Bla g 7 | 196 | Known Allergens |
| GNNLKSLEVSEEKAN | Bla g 7 | 201 | Known Allergens |
| SLEVSEEKANLREEE | Bla g 7 | 206 | Known Allergens |
| EEKANLREEEYKQQI | Bla g 7 | 211 | Known Allergens |
| LREEEYKQQIKTLNT | Bla g 7 | 216 | Known Allergens |
| YKQQIKTLNTRLKEA | Bla g 7 | 221 | Known Allergens |
| KTLNTRLKEAEARAE | Bla g 7 | 226 | Known Allergens |
| RLKEAEARAEFAERS | Bla g 7 | 231 | Known Allergens |
| EARAEFAERSVQKLQ | Bla g 7 | 236 | Known Allergens |
| FAERSVQKLQKEVDR | Bla g 7 | 241 | Known Allergens |
| VQKLQKEVDRLEDEL | Bla g 7 | 246 | Known Allergens |
| KEVDRLEDELVHEKE | Bla g 7 | 251 | Known Allergens |
| LEDELVHEKEKYKYI | Bla g 7 | 256 | Known Allergens |
| VHEKEKYKYICDDLD | Bla g 7 | 261 | Known Allergens |
| KYKYICDDLDMTFTE | Bla g 7 | 266 | Known Allergens |
| ICDDLDMTFTELIGN | Bla g 7 | 270 | Known Allergens |
| MVDAAVLEKLEAGFA | Bla g 9 | 1 | Known Allergens |
| VLEKLEAGFAKLAAS | Bla g 9 | 6 | Known Allergens |
| EAGFAKLAASDSKSL | Bla g 9 | 11 | Known Allergens |

TABLE 5-continued

Bla g Peptides Included in Epitope Screen. (SEQ ID NOs.: 257-1833)

| Sequence | Antigen | Position | Set |
|---|---|---|---|
| KLAASDSKSLLRKYL | Bla g 9 | 16 | Known Allergens |
| DSKSLLRKYLTKEVF | Bla g 9 | 21 | Known Allergens |
| LRKYLTKEVFDNLKT | Bla g 9 | 26 | Known Allergens |
| TKEVFDNLKTKKTPT | Bla g 9 | 31 | Known Allergens |
| DNLKTKKTPTFGSTL | Bla g 9 | 36 | Known Allergens |
| KKTPTFGSTLLDVIQ | Bla g 9 | 41 | Known Allergens |
| FGSTLLDVIQSGLEN | Bla g 9 | 46 | Known Allergens |
| LDVIQSGLENHDSGV | Bla g 9 | 51 | Known Allergens |
| SGLENHDSGVGIYAP | Bla g 9 | 56 | Known Allergens |
| HDSGVGIYAPDAEAY | Bla g 9 | 61 | Known Allergens |
| GIYAPDAEAYTVFAD | Bla g 9 | 66 | Known Allergens |
| DAEAYTVFADLFDPI | Bla g 9 | 71 | Known Allergens |
| TVFADLFDPIIEDYH | Bla g 9 | 76 | Known Allergens |
| LFDPIIEDYHGGFKK | Bla g 9 | 81 | Known Allergens |
| IEDYHGGFKKTDKHP | Bla g 9 | 86 | Known Allergens |
| GGFKKTDKHPPKDWG | Bla g 9 | 91 | Known Allergens |
| TDKHPPKDWGDVDTL | Bla g 9 | 96 | Known Allergens |
| PKDWGDVDTLGNLDP | Bla g 9 | 101 | Known Allergens |
| DVDTLGNLDPAGEYI | Bla g 9 | 106 | Known Allergens |
| GNLDPAGEYIISTRV | Bla g 9 | 111 | Known Allergens |
| AGEYIISTRVRCGRS | Bla g 9 | 116 | Known Allergens |
| ISTRVRCGRSMQGYP | Bla g 9 | 121 | Known Allergens |
| RCGRSMQGYPFNPCL | Bla g 9 | 126 | Known Allergens |
| MQGYPFNPCLTEAQY | Bla g 9 | 131 | Known Allergens |
| FNPCLTEAQYKEMED | Bla g 9 | 136 | Known Allergens |
| TEAQYKEMEDKVSST | Bla g 9 | 141 | Known Allergens |
| KEMEDKVSSTLSGLE | Bla g 9 | 146 | Known Allergens |
| KVSSTLSGLEGELKG | Bla g 9 | 151 | Known Allergens |
| LSGLEGELKGQFYPL | Bla g 9 | 156 | Known Allergens |
| GELKGQFYPLTGMTK | Bla g 9 | 161 | Known Allergens |
| QFYPLTGMTKEVQQK | Bla g 9 | 166 | Known Allergens |
| TGMTKEVQQKLIDDH | Bla g 9 | 171 | Known Allergens |
| EVQQKLIDDHFLFKE | Bla g 9 | 176 | Known Allergens |
| LIDDHFLFKEGDRFL | Bla g 9 | 181 | Known Allergens |
| FLFKEGDRFLQHANA | Bla g 9 | 186 | Known Allergens |
| GDRFLQHANACRFWP | Bla g 9 | 191 | Known Allergens |
| QHANACRFWPTGRGI | Bla g 9 | 196 | Known Allergens |

TABLE 5-continued

Bla g Peptides Included in Epitope Screen. (SEQ ID NOs.: 257-1833)

| Sequence | Antigen | Position | Set |
|---|---|---|---|
| CRFWPTGRGIYHNDA | Bla g 9 | 201 | Known Allergens |
| TGRGIYHNDAKTFLV | Bla g 9 | 206 | Known Allergens |
| YHNDAKTFLVWCNEE | Bla g 9 | 211 | Known Allergens |
| KTFLVWCNEEDHLRI | Bla g 9 | 216 | Known Allergens |
| WCNEEDHLRIISMQM | Bla g 9 | 221 | Known Allergens |
| DHLRIISMQMGGDLG | Bla g 9 | 226 | Known Allergens |
| ISMQMGGDLGQVYRR | Bla g 9 | 231 | Known Allergens |
| GGDLGQVYRRLVTAV | Bla g 9 | 236 | Known Allergens |
| QVYRRLVTAVNDIEK | Bla g 9 | 241 | Known Allergens |
| LVTAVNDIEKRVPFS | Bla g 9 | 246 | Known Allergens |
| NDIEKRVPFSHDDRL | Bla g 9 | 251 | Known Allergens |
| RVPFSHDDRLGFLTF | Bla g 9 | 256 | Known Allergens |
| HDDRLGFLTFCPTNL | Bla g 9 | 261 | Known Allergens |
| GFLTFCPTNLGTTVR | Bla g 9 | 266 | Known Allergens |
| CPTNLGTTVRASVRI | Bla g 9 | 271 | Known Allergens |
| GTTVRASVRIKVPKL | Bla g 9 | 276 | Known Allergens |
| ASVRIKVPKLAADKK | Bla g 9 | 281 | Known Allergens |
| KVPKLAADKKKLEEV | Bla g 9 | 286 | Known Allergens |
| AADKKKLEEVAGKYN | Bla g 9 | 291 | Known Allergens |
| KLEEVAGKYNLQVRG | Bla g 9 | 296 | Known Allergens |
| AGKYNLQVRGTRGEH | Bla g 9 | 301 | Known Allergens |
| LQVRGTRGEHTEAEG | Bla g 9 | 306 | Known Allergens |
| TRGEHTEAEGGVYDI | Bla g 9 | 311 | Known Allergens |
| TEAEGGVYDISNKRR | Bla g 9 | 316 | Known Allergens |
| GVYDISNKRRMGLTE | Bla g 9 | 321 | Known Allergens |
| SNKRRMGLTEYDAVK | Bla g 9 | 326 | Known Allergens |
| MGLTEYDAVKGMNDG | Bla g 9 | 331 | Known Allergens |
| YDAVKGMNDGIAELI | Bla g 9 | 336 | Known Allergens |
| GMNDGIAELIKIESS | Bla g 9 | 341 | Known Allergens |
| MNDGIAELIKIESSL | Bla g 9 | 342 | Known Allergens |
| MKLFPLVALLVLVVG | Bla g 11 | 1 | Known Allergens |
| LFPLVALLVLVVGVL | Bla g 11 | 3 | Known Allergens |
| ALLVLVVGVLSQKDP | Bla g 11 | 8 | Known Allergens |
| VVGVLSQKDPHVWDG | Bla g 11 | 13 | Known Allergens |
| HVWDGRSAIVHLFEW | Bla g 11 | 23 | Known Allergens |
| RSAIVHLFEWKFADI | Bla g 11 | 28 | Known Allergens |
| KGFAGVQVSPVHENV | Bla g 11 | 53 | Known Allergens |
| VHENVIISSPFRPWW | Bla g 11 | 63 | Known Allergens |

TABLE 5-continued

Bla g Peptides Included in Epitope Screen. (SEQ ID NOs.: 257-1833)

| Sequence | Antigen | Position | Set |
|---|---|---|---|
| FRPWWERYQLVSYKL | Bla g 11 | 73 | Known Allergens |
| ERYQLVSYKLVSRSG | Bla g 11 | 78 | Known Allergens |
| RDMVRRCNNVGIRIY | Bla g 11 | 98 | Known Allergens |
| RCNNVGIRIYVDVVL | Bla g 11 | 103 | Known Allergens |
| GIRIYVDVVLNQMSG | Bla g 11 | 108 | Known Allergens |
| VDVVLNQMSGSWPDA | Bla g 11 | 113 | Known Allergens |
| LNQGSDYVRGKMIEY | Bla g 11 | 178 | Known Allergens |
| DYVRGKMIEYLNHLV | Bla g 11 | 183 | Known Allergens |
| KMIEYLNHLVDCGVA | Bla g 11 | 188 | Known Allergens |
| DCGVAGFRVDAAKHM | Bla g 11 | 198 | Known Allergens |
| GFRVDAAKHMWPADL | Bla g 11 | 203 | Known Allergens |
| MKLFPLVALLVLVVG | alpha-amylase | 1 | Literature novel antigens |
| LFPLVALLVLVVGVL | alpha-amylase | 3 | Literature novel antigens |
| ALLVLVVGVLSQKDP | alpha-amylase | 8 | Literature novel antigens |
| VVGVLSQKDPHVWDG | alpha-amylase | 13 | Literature novel antigens |
| HVWDGRSAIVHLFEW | alpha-amylase | 23 | Literature novel antigens |
| RSAIVHLFEWKFADI | alpha-amylase | 28 | Literature novel antigens |
| KGFAGVQVSPVHENV | alpha-amylase | 53 | Literature novel antigens |
| VHENVIISSPFRPWW | alpha-amylase | 63 | Literature novel antigens |
| FRPWWERYQLVSYKL | alpha-amylase | 73 | Literature novel antigens |
| ERYQLVSYKLVSRSG | alpha-amylase | 78 | Literature novel antigens |
| RDMVRRCNNVGIRIY | alpha-amylase | 98 | Literature novel antigens |
| RCNNVGIRIYVDVVL | alpha-amylase | 103 | Literature novel antigens |
| GIRIYVDVVLNQMSG | alpha-amylase | 108 | Literature novel antigens |
| VDVVLNQMSGSWPDA | alpha-amylase | 113 | Literature novel antigens |
| LNQGSDYVRGKMIEY | alpha-amylase | 178 | Literature novel antigens |
| DYVRGKMIEYLNHLV | alpha-amylase | 183 | Literature novel antigens |
| KMIEYLNHLVDCGVA | alpha-amylase | 188 | Literature novel antigens |

TABLE 5-continued

Bla g Peptides Included in Epitope Screen. (SEQ ID NOs.: 257-1833)

| Sequence | Antigen | Position | Set |
|---|---|---|---|
| DCGVAGFRVDAAKHM | alpha-amylase | 198 | Literature novel antigens |
| GFRVDAAKHMWPADL | alpha-amylase | 203 | Literature novel antigens |
| AAKHMWPADLQYIYS | alpha-amylase | 208 | Literature novel antigens |
| WPADLQYIYSKVNNL | alpha-amylase | 213 | Literature novel antigens |
| QYIYSKVNNLNTDHG | alpha-amylase | 218 | Literature novel antigens |
| RPFFYQEVIDLGGEA | alpha-amylase | 238 | Literature novel antigens |
| IGDAFRGNNAIKWLV | alpha-amylase | 273 | Literature novel antigens |
| RGNNAIKWLVNFGVG | alpha-amylase | 278 | Literature novel antigens |
| IKWLVNFGVGWGYIP | alpha-amylase | 283 | Literature novel antigens |
| GASILTYKTSKLYKM | alpha-amylase | 318 | Literature novel antigens |
| TYKTSKLYKMAVAFM | alpha-amylase | 323 | Literature novel antigens |
| KLYKMAVAFMLAYPY | alpha-amylase | 328 | Literature novel antigens |
| AVAFMLAYPYGYPRV | alpha-amylase | 333 | Literature novel antigens |
| GYPRVMSSFSFDNSD | alpha-amylase | 343 | Literature novel antigens |
| DGNGNIISPSINADG | alpha-amylase | 363 | Literature novel antigens |
| WVCEHRWRQIFNMVG | alpha-amylase | 383 | Literature novel antigens |
| RWRQIFNMVGFRNAV | alpha-amylase | 388 | Literature novel antigens |
| FNMVGFRNAVAGTAV | alpha-amylase | 393 | Literature novel antigens |
| ISFCRGNKGFVAFND | alpha-amylase | 418 | Literature novel antigens |
| EFNNDLKQTLQTCLP | alpha-amylase | 433 | Literature novel antigens |
| YIEILSSADDGVLAI | alpha-amylase | 478 | Literature novel antigens |
| SSADDGVLAIHVNSK | alpha-amylase | 483 | Literature novel antigens |
| GVLAIHVNSKVGSKS | alpha-amylase | 488 | Literature novel antigens |
| VLEKLEAGFAKLAAS | Arginine kinase | 6 | Literature novel antigens |
| EAGFAKLAASDSKSL | Arginine kinase | 11 | Literature novel antigens |

TABLE 5-continued

Bla g Peptides Included in Epitope Screen. (SEQ ID NOs.: 257-1833)

| Sequence | Antigen | Position | Set |
|---|---|---|---|
| KLAASDSKSLLRKYL | Arginine kinase | 16 | Literature novel antigens |
| DSKSLLRKYLTKEVF | Arginine kinase | 21 | Literature novel antigens |
| LRKYLTKEVFDNLKT | Arginine kinase | 26 | Literature novel antigens |
| FGSTLLDVIQSGLEN | Arginine kinase | 46 | Literature novel antigens |
| DAEAYTVFADLFDPI | Arginine kinase | 71 | Literature novel antigens |
| AGEYIISTRVRCGRS | Arginine kinase | 116 | Literature novel antigens |
| RCGRSMQGYPFNPCL | Arginine kinase | 126 | Literature novel antigens |
| LIDDHFLFKEGDRFL | Arginine kinase | 181 | Literature novel antigens |
| FLFKEGDRFLQHANA | Arginine kinase | 186 | Literature novel antigens |
| GDRFLQHANACRFWP | Arginine kinase | 191 | Literature novel antigens |
| TGRGIYHNDAKTFLV | Arginine kinase | 206 | Literature novel antigens |
| WCNEEDHLRIISMQM | Arginine kinase | 221 | Literature novel antigens |
| DHLRIISMQMGGDLG | Arginine kinase | 226 | Literature novel antigens |
| QVYRRLVTAVNDIEK | Arginine kinase | 241 | Literature novel antigens |
| NDIEKRVPFSHDDRL | Arginine kinase | 251 | Literature novel antigens |
| RVPFSHDDRLGFLTF | Arginine kinase | 256 | Literature novel antigens |
| HDDRLGFLTFCPTNL | Arginine kinase | 261 | Literature novel antigens |
| GFLTFCPTNLGTTVR | Arginine kinase | 266 | Literature novel antigens |
| CPTNLGTTVRASVRI | Arginine kinase | 271 | Literature novel antigens |
| GTTVRASVRIKVPKL | Arginine kinase | 276 | Literature novel antigens |
| ASVRIKVPKLAADKK | Arginine kinase | 281 | Literature novel antigens |
| MPLQKLFARRIFDSR | Enolase | 1 | Literature Novel Antigens |
| LFARRIFDSRGNPTI | Enolase | 6 | Literature Novel Antigens |
| EVDLTTDLGLFRAAV | Enolase | 21 | Literature Novel Antigens |
| TDLGLFRAAVPSGAS | Enolase | 26 | Literature Novel Antigens |

TABLE 5-continued

Bla g Peptides Included in Epitope Screen. (SEQ ID NOs.: 257-1833)

| Sequence | Antigen | Position | Set |
|---|---|---|---|
| IDNVNKIIVPELLKQ | Enolase | 66 | Literature Novel Antigens |
| ELLKQSFEATQQKEI | Enolase | 76 | Literature Novel Antigens |
| DDFMLKLDGTPNKSK | Enolase | 91 | Literature Novel Antigens |
| PNKSKLGANAILGVS | Enolase | 101 | Literature Novel Antigens |
| LGANAILGVSIAVCK | Enolase | 106 | Literature Novel Antigens |
| KGVPLYRHIADLAGV | Enolase | 126 | Literature Novel Antigens |
| YRHIADLAGVPDVIL | Enolase | 131 | Literature Novel Antigens |
| GVPDVILPVPAFNVI | Enolase | 139 | Literature Novel Antigens |
| PDVILPVPAFNVING | Enolase | 141 | Literature Novel Antigens |
| QEFMILPTGAATFTE | Enolase | 166 | Literature Novel Antigens |
| SEVYHHLKNVIQGKF | Enolase | 186 | Literature Novel Antigens |
| HLKNVIQGKFGLDAT | Enolase | 191 | Literature Novel Antigens |
| IQGKFGLDATAVGDE | Enolase | 196 | Literature Novel Antigens |
| WIDKDQLTALYMEFI | Enolase | 271 | Literature Novel Antigens |
| QLTALYMEFIKEFPV | Enolase | 276 | Literature Novel Antigens |
| YMEFIKEFPVVSIED | Enolase | 281 | Literature Novel Antigens |
| HWDAWTAMTAATPIQ | Enolase | 301 | Literature Novel Antigens |
| TAMTAATPIQIVGDD | Enolase | 306 | Literature Novel Antigens |
| IVGDDLTVTNPTRIQ | Enolase | 316 | Literature Novel Antigens |
| LTVTNPTRIQTAIDK | Enolase | 321 | Literature Novel Antigens |
| KACNCLLLKVNQIGT | Enolase | 336 | Literature Novel Antigens |
| FIADLVVGLSTGQIK | Enolase | 381 | Literature Novel Antigens |
| RSERLAKYNQILRIE | Enolase | 401 | Literature Novel Antigens |
| MAKDIKFDIEARDKL | Hsp60 | 1 | Literature Novel Antigens |
| KKGVDALANAVKVTL | Hsp60 | 16 | Literature Novel Antigens |

TABLE 5-continued

Bla g Peptides Included in Epitope Screen. (SEQ ID NOs.: 257-1833)

| Sequence | Antigen | Position | Set |
|---|---|---|---|
| NVVLQKSFGGPQVTK | Hsp60 | 36 | Literature Novel Antigens |
| LEDPIENLGAQMVKE | Hsp60 | 61 | Literature Novel Antigens |
| DGTTTATVLAQAIVR | Hsp60 | 86 | Literature Novel Antigens |
| RALEAVIIDLRKQSR | Hsp60 | 121 | Literature Novel Antigens |
| VIIDLRKQSREVGGN | Hsp60 | 126 | Literature Novel Antigens |
| TEKIKQVASISANND | Hsp60 | 141 | Literature Novel Antigens |
| EGMQFDRGYQSPYFV | Hsp60 | 191 | Literature Novel Antigens |
| SPYFVTNTEKMITEF | Hsp60 | 201 | Literature Novel Antigens |
| DQPQILLSDKKIAAM | Hsp60 | 216 | Literature Novel Antigens |
| LLSDKKIAAMKDLLP | Hsp60 | 221 | Literature Novel Antigens |
| KIAAMKDLLPILEPV | Hsp60 | 226 | Literature Novel Antigens |
| KDLLPILEPVAQSGK | Hsp60 | 231 | Literature Novel Antigens |
| ILEPVAQSGKPLLII | Hsp60 | 236 | Literature Novel Antigens |
| GEALATLVVNKIRGT | Hsp60 | 256 | Literature Novel Antigens |
| TLVVNKIRGTLKVAA | Hsp60 | 261 | Literature Novel Antigens |
| KIRGTLKVAAIKAPG | Hsp60 | 266 | Literature Novel Antigens |
| LKVAAIKAPGFGDRR | Hsp60 | 271 | Literature Novel Antigens |
| KAMLEDIAILTGGSV | Hsp60 | 286 | Literature Novel Antigens |
| DIAILTGGSVISEET | Hsp60 | 291 | Literature Novel Antigens |
| GSKLEDVKLNMLGKA | Hsp60 | 306 | Literature Novel Antigens |
| DVKLNMLGKAERVII | Hsp60 | 311 | Literature Novel Antigens |
| QERLAKLAGGVAVLY | Hsp60 | 366 | Literature Novel Antigens |
| VAVLYVGAASEVEMK | Hsp60 | 376 | Literature Novel Antigens |
| VDDALNATRAAVEEG | Hsp60 | 396 | Literature Novel Antigens |
| IVAGGGVALVRAINS | Hsp60 | 411 | Literature Novel Antigens |

TABLE 5-continued

Bla g Peptides Included in Epitope Screen. (SEQ ID NOs.: 257-1833)

| Sequence | Antigen | Position | Set |
|---|---|---|---|
| GVALVRAINSLDNLR | Hsp60 | 416 | Literature Novel Antigens |
| RAINSLDNLRGENAD | Hsp60 | 421 | Literature Novel Antigens |
| QDTGIQIVRRSLEEP | Hsp60 | 436 | Literature Novel Antigens |
| KIGEYKNMIAEGIID | Hsp60 | 481 | Literature Novel Antigens |
| EGIIDPTKVARVALE | Hsp60 | 491 | Literature Novel Antigens |
| PTKVARVALENAASV | Hsp60 | 496 | Literature Novel Antigens |
| RVALENAASVSGMLL | Hsp60 | 501 | Literature Novel Antigens |
| VTEIKKDENNAVPSM | Hsp60 | 521 | Literature Novel Antigens |
| GWVTQIATNPKYPDM | RACK1 | 16 | Literature Novel Antigens |
| KYPDMILSCSRDKTL | RACK1 | 26 | Literature Novel Antigens |
| ILSCSRDKTLIVWKL | RACK1 | 31 | Literature Novel Antigens |
| RDKTLIVWKLTRDET | RACK1 | 36 | Literature Novel Antigens |
| GHSHFVSDVVLSSDG | RACK1 | 61 | Literature Novel Antigens |
| VSDVVLSSDGNYALS | RACK1 | 66 | Literature Novel Antigens |
| LSSDGNYALSGSWDK | RACK1 | 71 | Literature Novel Antigens |
| NYALSGSWDKTLRLW | RACK1 | 76 | Literature Novel Antigens |
| TLRLWDLAAGRTTRR | RACK1 | 86 | Literature Novel Antigens |
| KDVLSVAFSVDNRQI | RACK1 | 106 | Literature Novel Antigens |
| VAFSVDNRQIVSGSR | RACK1 | 111 | Literature Novel Antigens |
| DKTIKLWNTLAECKY | RACK1 | 126 | Literature Novel Antigens |
| VSCVRFSPNHSNPII | RACK1 | 151 | Literature Novel Antigens |
| FSPNHSNPIIVSAGW | RACK1 | 156 | Literature Novel Antigens |
| SNPIIVSAGWDKVVK | RACK1 | 161 | Literature Novel Antigens |
| DKVVKVWNLTNCKLK | RACK1 | 171 | Literature Novel Antigens |
| VWNLTNCKLKINHIG | RACK1 | 176 | Literature Novel Antigens |

TABLE 5-continued

Bla g Peptides Included in Epitope Screen. (SEQ ID NOs.: 257-1833)

| Sequence | Antigen | Position | Set |
|---|---|---|---|
| NCKLKINHIGHTGYL | RACK1 | 181 | Literature Novel Antigens |
| GKDCKAMLWDLNDGK | RACK1 | 211 | Literature Novel Antigens |
| AMLWDLNDGKHLHTL | RACK1 | 216 | Literature Novel Antigens |
| DHNDIITALCFSPNR | RACK1 | 231 | Literature Novel Antigens |
| ITALCFSPNRYWLCA | RACK1 | 236 | Literature Novel Antigens |
| YWLCAAFGPSIKIWD | RACK1 | 246 | Literature Novel Antigens |
| QTLFAGYFDNTIRVW | RACK1 | 296 | Literature Novel Antigens |
| GYFDNTIRVWQVSVF | RACK1 | 301 | Literature Novel Antigens |
| FDNTIRVWQVSVFAR | RACK1 | 303 | Literature Novel Antigens |
| MGRKFWVGGNWKMNG | TPI | 1 | Literature Novel Antigens |
| EEIVKFLAAGPLDPN | TPI | 21 | Literature Novel Antigens |
| VEVVVGIPAIYLEST | TPI | 36 | Literature Novel Antigens |
| GIPAIYLESTKNILP | TPI | 41 | Literature Novel Antigens |
| YLESTKNILPSNVAA | TPI | 46 | Literature Novel Antigens |
| KNILPSNVAAAQNC | TPI | 51 | Literature Novel Antigens |
| GAFTGEISPAMLNDI | TPI | 71 | Literature Novel Antigens |
| EISPAMLNDIGINWV | TPI | 76 | Literature Novel Antigens |
| MLNDIGINWVILGHS | TPI | 81 | Literature Novel Antigens |
| GINWVILGHSERRNV | TPI | 86 | Literature Novel Antigens |
| FGEKDDLISDKVVHA | TPI | 101 | Literature Novel Antigens |
| DLISDKVVHALESGL | TPI | 106 | Literature Novel Antigens |
| KVVHALESGLNVVAC | TPI | 111 | Literature Novel Antigens |
| GKTEEVVFQQTKAIA | TPI | 136 | Literature Novel Antigens |
| VVFQQTKAIADKIKD | TPI | 141 | Literature Novel Antigens |
| DKIKDWSKVVIAYEP | TPI | 151 | Literature Novel Antigens |

TABLE 5-continued

Bla g Peptides Included in Epitope Screen. (SEQ ID NOs.: 257-1833)

| Sequence | Antigen | Position | Set |
|---|---|---|---|
| WSKVVIAYEPVWAIG | TPI | 156 | Literature Novel Antigens |
| IAYEPVWAIGTGKTA | TPI | 161 | Literature Novel Antigens |
| QDVHKKLREWLSKNV | TPI | 181 | Literature Novel Antigens |
| DGFLVGGASLKPEFV | TPI | 226 | Literature Novel Antigens |
| GGASLKPEFVQIINA | TPI | 231 | Literature Novel Antigens |
| ASLKPEFVQIINAKN | TPI | 233 | Literature Novel Antigens |
| MFRLVVIATLLVASC | Trypsin | 1 | Literature Novel Antigens |
| VIATLLVASCLGAAT | Trypsin | 6 | Literature Novel Antigens |
| QLQFEYYGSLMCGAS | Trypsin | 46 | Literature Novel Antigens |
| YWTIDFDIAVARVST | Trypsin | 111 | Literature Novel Antigens |
| DYDGITANMICAAVP | Trypsin | 186 | Literature Novel Antigens |
| YPGVYSNVATLRDFV | Trypsin | 236 | Literature Novel Antigens |
| MTWNALLCCLLVSAA | Vitellogenin | 1 | Literature Novel Antigens |
| NALLCCLLVSAASAI | Vitellogenin | 4 | Literature Novel Antigens |
| AASAITPGWLPINSQ | Vitellogenin | 14 | Literature Novel Antigens |
| VANQYTGILYKARLS | Vitellogenin | 44 | Literature Novel Antigens |
| KARLSLDRNEDQLIT | Vitellogenin | 54 | Literature Novel Antigens |
| LDRNEDQLITGKVTE | Vitellogenin | 59 | Literature Novel Antigens |
| DQLITGKVTEAQFSP | Vitellogenin | 64 | Literature Novel Antigens |
| GKVTEAQFSPVNTQF | Vitellogenin | 69 | Literature Novel Antigens |
| AQFSPVNTQFSSGWD | Vitellogenin | 74 | Literature Novel Antigens |
| VNTQFSSGWDESVPD | Vitellogenin | 79 | Literature Novel Antigens |
| SSGWDESVPDEKLHW | Vitellogenin | 84 | Literature Novel Antigens |
| ESVPDEKLHWDVVPM | Vitellogenin | 89 | Literature Novel Antigens |
| QIELNSRGEVRKLRV | Vitellogenin | 109 | Literature Novel Antigens |

TABLE 5-continued

Bla g Peptides Included in Epitope Screen. (SEQ ID NOs.: 257-1833)

| Sequence | Antigen | Position | Set |
|---|---|---|---|
| VVVDEDKKVYRVFES | Vitellogenin | 144 | Literature Novel Antigens |
| RVFESTVTGRCEALY | Vitellogenin | 154 | Literature Novel Antigens |
| TVTGRCEALYEVDHL | Vitellogenin | 159 | Literature Novel Antigens |
| CEALYEVDHLYPTTY | Vitellogenin | 164 | Literature Novel Antigens |
| EVDHLYPTTYLNPWQ | Vitellogenin | 169 | Literature Novel Antigens |
| YPTTYLNPWQWTQQH | Vitellogenin | 174 | Literature Novel Antigens |
| LNPWQWTQQHDTKLR | Vitellogenin | 179 | Literature Novel Antigens |
| WTQQHDTKLRIMKTH | Vitellogenin | 184 | Literature Novel Antigens |
| DTKLRIMKTHQFTNC | Vitellogenin | 189 | Literature Novel Antigens |
| IMKTHQFTNCRHNSA | Vitellogenin | 194 | Literature Novel Antigens |
| NAFEYFHLKQHKPET | Vitellogenin | 214 | Literature Novel Antigens |
| AVSRVIADGDNLKNF | Vitellogenin | 234 | Literature Novel Antigens |
| IADGDNLKNFTFYSG | Vitellogenin | 239 | Literature Novel Antigens |
| IVLNPEIYNKQKGML | Vitellogenin | 259 | Literature Novel Antigens |
| VSHINVTVERKGREL | Vitellogenin | 274 | Literature Novel Antigens |
| VTVERKGRELTVIDY | Vitellogenin | 279 | Literature Novel Antigens |
| ELRNVGDLSYSTSLV | Vitellogenin | 294 | Literature Novel Antigens |
| RNSASMDLSSSSMSS | Vitellogenin | 314 | Literature Novel Antigens |
| MDLSSSSMSSSSSSS | Vitellogenin | 319 | Literature Novel Antigens |
| SSMSSSSSSSSSSSS | Vitellogenin | 324 | Literature Novel Antigens |
| SSSSSSSSSSSSSSS | Vitellogenin | 329 | Literature Novel Antigens |
| SSSSSSSSSSSSSSS | Vitellogenin | 334 | Literature Novel Antigens |
| SSSSSSSSSSSEEHH | Vitellogenin | 339 | Literature Novel Antigens |
| SSSSSSEEHHSHNQK | Vitellogenin | 344 | Literature Novel Antigens |
| SEEHHSHNQKLSKKR | Vitellogenin | 349 | Literature Novel Antigens |

TABLE 5-continued

Bla g Peptides Included in Epitope Screen. (SEQ ID NOs.: 257-1833)

| Sequence | Antigen | Position | Set |
|---|---|---|---|
| QVPLPRPLFEANFDA | Vitellogenin | 364 | Literature Novel Antigens |
| RPLFEANFDASSGLT | Vitellogenin | 369 | Literature Novel Antigens |
| ANFDASSGLTTEQPV | Vitellogenin | 374 | Literature Novel Antigens |
| SSGLTTEQPVTFRPR | Vitellogenin | 379 | Literature Novel Antigens |
| TEQPVTFRPRRQLFQ | Vitellogenin | 384 | Literature Novel Antigens |
| TFRPRRQLFQGQDMS | Vitellogenin | 389 | Literature Novel Antigens |
| RQLFQGQDMSEEETE | Vitellogenin | 394 | Literature Novel Antigens |
| GQDMSEEETEQNPEI | Vitellogenin | 399 | Literature Novel Antigens |
| EEETEQNPEIIPANL | Vitellogenin | 404 | Literature Novel Antigens |
| LIHNTKQVDVDPVGV | Vitellogenin | 424 | Literature Novel Antigens |
| KQVDVDPVGVAVRLS | Vitellogenin | 429 | Literature Novel Antigens |
| KDIAADLQGEPRVGE | Vitellogenin | 444 | Literature Novel Antigens |
| DLQGEPRVGEDRHIL | Vitellogenin | 449 | Literature Novel Antigens |
| PRVGEDRHILPRFTI | Vitellogenin | 454 | Literature Novel Antigens |
| AARKLYKLENDHPNY | Vitellogenin | 484 | Literature Novel Antigens |
| DHPNYMNWDTWRVYR | Vitellogenin | 494 | Literature Novel Antigens |
| MNWDTWRVYRDAVSQ | Vitellogenin | 499 | Literature Novel Antigens |
| WRVYRDAVSQAGTWS | Vitellogenin | 504 | Literature Novel Antigens |
| DAVSQAGTWSALNSI | Vitellogenin | 509 | Literature Novel Antigens |
| SEMVEPKEASHLITV | Vitellogenin | 529 | Literature Novel Antigens |
| LPAAVSDKNKAYLHF | Vitellogenin | 544 | Literature Novel Antigens |
| SDKNKAYLHFLFEMT | Vitellogenin | 549 | Literature Novel Antigens |
| IPYLVQEFDDAVKEN | Vitellogenin | 604 | Literature Novel Antigens |
| EHNPRKVIDLLLSLY | Vitellogenin | 669 | Literature Novel Antigens |
| LDQNEHADIRVEALF | Vitellogenin | 684 | Literature Novel Antigens |

TABLE 5-continued

Bla g Peptides Included in Epitope Screen. (SEQ ID NOs.: 257-1833)

| Sequence | Antigen | Position | Set |
|---|---|---|---|
| AELTHTESNNQVLSA | Vitellogenin | 714 | Literature Novel Antigens |
| TESNNQVLSASQSAI | Vitellogenin | 719 | Literature Novel Antigens |
| SQSAIKSAANVEGDI | Vitellogenin | 729 | Literature Novel Antigens |
| KSAANVEGDIYSEMR | Vitellogenin | 734 | Literature Novel Antigens |
| VEGDIYSEMRRKAKA | Vitellogenin | 739 | Literature Novel Antigens |
| RKAKAVEHLLSTRNM | Vitellogenin | 749 | Literature Novel Antigens |
| KINYDSLYNLNYIGS | Vitellogenin | 779 | Literature Novel Antigens |
| SLYNLNYIGSEDSIY | Vitellogenin | 784 | Literature Novel Antigens |
| NYIGSEDSIYPKSML | Vitellogenin | 789 | Literature Novel Antigens |
| NNLGRINTHVQKGYM | Vitellogenin | 809 | Literature Novel Antigens |
| INTHVQKGYMVSSMT | Vitellogenin | 814 | Literature Novel Antigens |
| VSSMTDLWEAFHTIY | Vitellogenin | 824 | Literature Novel Antigens |
| FHTIYKKDNGSPTDP | Vitellogenin | 834 | Literature Novel Antigens |
| KKDNGSPTDPKTLVK | Vitellogenin | 839 | Literature Novel Antigens |
| SPTDPKTLVKFVEGN | Vitellogenin | 844 | Literature Novel Antigens |
| FVEGNLKYFNMGVQK | Vitellogenin | 854 | Literature Novel Antigens |
| KTYKKPTNFNHTKLS | Vitellogenin | 889 | Literature Novel Antigens |
| TLTLPCAMGLPAYFK | Vitellogenin | 909 | Literature Novel Antigens |
| CAMGLPAYFKMNSPS | Vitellogenin | 914 | Literature Novel Antigens |
| LWKYNGEFSIQTDAK | Vitellogenin | 929 | Literature Novel Antigens |
| QTDAKTDVPMSLENF | Vitellogenin | 939 | Literature Novel Antigens |
| HAQLAFSTAFDNKEY | Vitellogenin | 969 | Literature Novel Antigens |
| FSTAFDNKEYISGLD | Vitellogenin | 974 | Literature Novel Antigens |
| DNKEYISGLDRKVEV | Vitellogenin | 979 | Literature Novel Antigens |
| ISGLDRKVEVHVPVK | Vitellogenin | 984 | Literature Novel Antigens |

TABLE 5-continued

Bla g Peptides Included in Epitope Screen. (SEQ ID NOs.: 257-1833)

| Sequence | Antigen | Position | Set |
|---|---|---|---|
| IIPLFTDRDYDVLQW | Vitellogenin | 1014 | Literature Novel Antigens |
| TDRDYDVLQWQTIPY | Vitellogenin | 1019 | Literature Novel Antigens |
| TTIHNVPDFETVYMD | Vitellogenin | 1034 | Literature Novel Antigens |
| TAHFEKKMGENTGIV | Vitellogenin | 1059 | Literature Novel Antigens |
| KKMGENTGIVFKVKY | Vitellogenin | 1064 | Literature Novel Antigens |
| DTDQEFLDTKWFLDE | Vitellogenin | 1079 | Literature Novel Antigens |
| LFTGLNYDVPTKDIF | Vitellogenin | 1099 | Literature Novel Antigens |
| NYDVPTKDIFYNNLT | Vitellogenin | 1104 | Literature Novel Antigens |
| YNNLTVYYDHEDTKN | Vitellogenin | 1114 | Literature Novel Antigens |
| VYYDHEDTKNHAVSF | Vitellogenin | 1119 | Literature Novel Antigens |
| EDTKNHAVSFTVTKE | Vitellogenin | 1124 | Literature Novel Antigens |
| HAVSFTVTKEQSKFY | Vitellogenin | 1129 | Literature Novel Antigens |
| TVTKEQSKFYETLNP | Vitellogenin | 1134 | Literature Novel Antigens |
| LKLSSGKKQKHRNVK | Vitellogenin | 1154 | Literature Novel Antigens |
| GKKQKHRNVKSHRIR | Vitellogenin | 1159 | Literature Novel Antigens |
| SHRIRREYTEDENPA | Vitellogenin | 1169 | Literature Novel Antigens |
| REYTEDENPAIPKDK | Vitellogenin | 1174 | Literature Novel Antigens |
| DENPAIPKDKQPNSH | Vitellogenin | 1179 | Literature Novel Antigens |
| IPKDKQPNSHPRRQE | Vitellogenin | 1184 | Literature Novel Antigens |
| QPNSHPRRQEYLSKS | Vitellogenin | 1189 | Literature Novel Antigens |
| MALTGDATAVVLDMT | Vitellogenin | 1204 | Literature Novel Antigens |
| VLDMTLKFEGPAESY | Vitellogenin | 1214 | Literature Novel Antigens |
| LKFEGPAESYFTTTV | Vitellogenin | 1219 | Literature Novel Antigens |
| FYDQHYYEEKKRNQF | Vitellogenin | 1249 | Literature Novel Antigens |
| YYEEKKRNQFCLSWS | Vitellogenin | 1254 | Literature Novel Antigens |

TABLE 5-continued

Bla g Peptides Included in Epitope
Screen. (SEQ ID NOs.: 257-1833)

| Sequence | Antigen | Position | Set |
|---|---|---|---|
| EFDPNSKVHAIMNIG | Vitellogenin | 1284 | Literature Novel Antigens |
| IMNIGKECENGGSAV | Vitellogenin | 1294 | Literature Novel Antigens |
| KECENGGSAVANIDM | Vitellogenin | 1299 | Literature Novel Antigens |
| KNLTVSKLCDHEMRT | Vitellogenin | 1324 | Literature Novel Antigens |
| SKLCDHEMRTKRDHV | Vitellogenin | 1329 | Literature Novel Antigens |
| HEMRTKRDHVLPACR | Vitellogenin | 1334 | Literature Novel Antigens |
| KRDHVLPACRNSTER | Vitellogenin | 1339 | Literature Novel Antigens |
| LPACRNSTERASDLN | Vitellogenin | 1344 | Literature Novel Antigens |
| NSTERASDLNRVHVD | Vitellogenin | 1349 | Literature Novel Antigens |
| INYNLKQHETFKRRV | Vitellogenin | 1364 | Literature Novel Antigens |
| KQHETFKRRVYKVYD | Vitellogenin | 1369 | Literature Novel Antigens |
| LYPHVSEDVIVDNPA | Vitellogenin | 1389 | Literature Novel Antigens |
| DNTRAFNVSIETPVL | Vitellogenin | 1414 | Literature Novel Antigens |
| FNVSIETPVLSVNAT | Vitellogenin | 1419 | Literature Novel Antigens |
| ETPVLSVNATSVRLQ | Vitellogenin | 1424 | Literature Novel Antigens |
| SVNATSVRLQSWQSE | Vitellogenin | 1429 | Literature Novel Antigens |
| SVRLQSWQSEMLRMN | Vitellogenin | 1434 | Literature Novel Antigens |
| PRTSFAKRFAKWALP | Vitellogenin | 1449 | Literature Novel Antigens |
| AKRFAKWALPLYYKP | Vitellogenin | 1454 | Literature Novel Antigens |
| KWALPLYYKPTCVVD | Vitellogenin | 1459 | Literature Novel Antigens |
| LYYKPTCVVDSSYIN | Vitellogenin | 1464 | Literature Novel Antigens |
| TCVVDSSYINTFDNF | Vitellogenin | 1469 | Literature Novel Antigens |
| ILDIPQKFNMEYFKV | Vitellogenin | 1499 | Literature Novel Antigens |
| AFKPTSPVPNMQREV | Vitellogenin | 1514 | Literature Novel Antigens |
| SPVPNMQREVLVFLR | Vitellogenin | 1519 | Literature Novel Antigens |

TABLE 5-continued

Bla g Peptides Included in Epitope Screen. (SEQ ID NOs.: 257-1833)

| Sequence | Antigen | Position | Set |
|---|---|---|---|
| NAKIELKPNQGMPEV | Vitellogenin | 1534 | Literature Novel Antigens |
| LKPNQGMPEVYVEGK | Vitellogenin | 1539 | Literature Novel Antigens |
| GMPEVYVEGKRVDYN | Vitellogenin | 1544 | Literature Novel Antigens |
| YVEGKRVDYNHHHST | Vitellogenin | 1549 | Literature Novel Antigens |
| RVDYNHHHSTDLNVS | Vitellogenin | 1554 | Literature Novel Antigens |
| HHHSTDLNVSQDRIG | Vitellogenin | 1559 | Literature Novel Antigens |
| DLNVSQDRIGYVYAL | Vitellogenin | 1564 | Literature Novel Antigens |
| QDRIGYVYALPTKAA | Vitellogenin | 1569 | Literature Novel Antigens |
| YVYALPTKAAHIVFP | Vitellogenin | 1574 | Literature Novel Antigens |
| PTKAAHIVFPSYEIE | Vitellogenin | 1579 | Literature Novel Antigens |
| HIVFPSYEIEMFYDG | Vitellogenin | 1584 | Literature Novel Antigens |
| SYEIEMFYDGSRIMI | Vitellogenin | 1589 | Literature Novel Antigens |
| MFYDGSRIMIQASNM | Vitellogenin | 1594 | Literature Novel Antigens |
| SRIMIQASNMYRNFT | Vitellogenin | 1599 | Literature Novel Antigens |
| QASNMYRNFTKGLCG | Vitellogenin | 1604 | Literature Novel Antigens |
| YRNFTKGLCGNMDGE | Vitellogenin | 1609 | Literature Novel Antigens |
| KGLCGNMDGEFVNDV | Vitellogenin | 1614 | Literature Novel Antigens |
| NMDGEFVNDVLTPWG | Vitellogenin | 1619 | Literature Novel Antigens |
| FVNDVLTPWGCYAKD | Vitellogenin | 1624 | Literature Novel Antigens |
| LTPWGCYAKDMALFV | Vitellogenin | 1629 | Literature Novel Antigens |
| CYAKDMALFVASYAD | Vitellogenin | 1634 | Literature Novel Antigens |
| MALFVASYADNSNSE | Vitellogenin | 1639 | Literature Novel Antigens |
| ASYADNSNSEVRKIK | Vitellogenin | 1644 | Literature Novel Antigens |
| NSNSEVRKIKATQNE | Vitellogenin | 1649 | Literature Novel Antigens |
| VRKIKATQNEQTCVP | Vitellogenin | 1654 | Literature Novel Antigens |

TABLE 5-continued

Bla g Peptides Included in Epitope Screen. (SEQ ID NOs.: 257-1833)

| Sequence | Antigen | Position | Set |
|---|---|---|---|
| ATQNEQTCVPQFHQP | Vitellogenin | 1659 | Literature Novel Antigens |
| QTCVPQFHQPLVSHQ | Vitellogenin | 1664 | Literature Novel Antigens |
| QFHQPLVSHQMRLSQ | Vitellogenin | 1669 | Literature Novel Antigens |
| LVSHQMRLSQVIKLA | Vitellogenin | 1674 | Literature Novel Antigens |
| MRLSQVIKLADTSSS | Vitellogenin | 1679 | Literature Novel Antigens |
| VIKLADTSSSSESSS | Vitellogenin | 1684 | Literature Novel Antigens |
| DTSSSSESSSSSESH | Vitellogenin | 1689 | Literature Novel Antigens |
| SESSSSSESHENNSS | Vitellogenin | 1694 | Literature Novel Antigens |
| SSESHENNSSPSSES | Vitellogenin | 1699 | Literature Novel Antigens |
| ENNSSPSSESQVNKS | Vitellogenin | 1704 | Literature Novel Antigens |
| PSSESQVNKSKRQPN | Vitellogenin | 1709 | Literature Novel Antigens |
| QVNKSKRQPNSRPRS | Vitellogenin | 1714 | Literature Novel Antigens |
| KRQPNSRPRSSSSSS | Vitellogenin | 1719 | Literature Novel Antigens |
| SRPRSSSSSSSSSSS | Vitellogenin | 1724 | Literature Novel Antigens |
| SSSSSSSSSSESNES | Vitellogenin | 1729 | Literature Novel Antigens |
| SSSSSESNESVLAKK | Vitellogenin | 1734 | Literature Novel Antigens |
| ESNESVLAKKIINNQ | Vitellogenin | 1739 | Literature Novel Antigens |
| VLAKKIINNQIGPKP | Vitellogenin | 1744 | Literature Novel Antigens |
| IINNQIGPKPTLIPS | Vitellogenin | 1749 | Literature Novel Antigens |
| IGPKPTLIPSQSPMT | Vitellogenin | 1754 | Literature Novel Antigens |
| TLIPSQSPMTSDDKC | Vitellogenin | 1759 | Literature Novel Antigens |
| QSPMTSDDKCMTQQP | Vitellogenin | 1764 | Literature Novel Antigens |
| SDDKCMTQQPRHTYY | Vitellogenin | 1769 | Literature Novel Antigens |
| MTQQPRHTYYENQFC | Vitellogenin | 1774 | Literature Novel Antigens |
| RHTYYENQFCVSEKP | Vitellogenin | 1779 | Literature Novel Antigens |

TABLE 5-continued

Bla g Peptides Included in Epitope
Screen. (SEQ ID NOs.: 257-1833)

| Sequence | Antigen | Position | Set |
|---|---|---|---|
| ENQFCVSEKPLDTCM | Vitellogenin | 1784 | Literature Novel Antigens |
| VSEKPLDTCMPLICH | Vitellogenin | 1789 | Literature Novel Antigens |
| LDTCMPLICHATESY | Vitellogenin | 1794 | Literature Novel Antigens |
| PLICHATESYTIDVN | Vitellogenin | 1799 | Literature Novel Antigens |
| ATESYTIDVNFYCVP | Vitellogenin | 1804 | Literature Novel Antigens |
| TIDVNFYCVPLGPAA | Vitellogenin | 1809 | Literature Novel Antigens |
| FYCVPLGPAANHYMK | Vitellogenin | 1814 | Literature Novel Antigens |
| LGPAANHYMKLVKKG | Vitellogenin | 1819 | Literature Novel Antigens |
| NHYMKLVKKGILPDL | Vitellogenin | 1824 | Literature Novel Antigens |
| LVKKGILPDLSRNRN | Vitellogenin | 1829 | Literature Novel Antigens |
| ILPDLSRNRNGKRVV | Vitellogenin | 1834 | Literature Novel Antigens |
| SRNRNGKRVVLPVEI | Vitellogenin | 1839 | Literature Novel Antigens |
| GKRVVLPVEIPIQCE | Vitellogenin | 1844 | Literature Novel Antigens |
| VLPVEIPIQCEPVLN | Vitellogenin | 1849 | Literature Novel Antigens |
| SCITYQRGSHAGNKL | Enolase | 11 | Literature Novel Antigens |
| AGNKLAMQEFMILPT | Enolase | 21 | Literature Novel Antigens |
| NKLAMQEFMILPTGA | Enolase | 23 | Literature Novel Antigens |
| AMQEFMILPTGAATF | Enolase | 26 | Literature Novel Antigens |
| MGSEVYHHLKNVIKG | Enolase | 46 | Literature Novel Antigens |
| YHHLKNVIKGKFGLD | Enolase | 51 | Literature Novel Antigens |
| KDGLDLIKDAIEKAG | Enolase | 83 | Literature Novel Antigens |
| LDLIKDAIEKAGYTG | Enolase | 86 | Literature Novel Antigens |
| LIKDAIEKAGYTGKI | Enolase | 88 | Literature Novel Antigens |
| KIEIGMDVAASEFFR | Enolase | 101 | Literature Novel Antigens |
| KYDLDFKNPNTDKSK | Enolase | 118 | Literature Novel Antigens |

TABLE 5-continued

Bla g Peptides Included in Epitope Screen. (SEQ ID NOs.: 257-1833)

| Sequence | Antigen | Position | Set |
|---|---|---|---|
| SKWIDKDQLTALYME | Enolase | 131 | Literature Novel Antigens |
| KDQLTALYMEFIKEF | Enolase | 136 | Literature Novel Antigens |
| ALYMEFIKEFPVVSI | Enolase | 141 | Literature Novel Antigens |
| FIKEFPVVSIEDPFD | Enolase | 146 | Literature Novel Antigens |
| QDHWDAWTAMTAATP | Enolase | 161 | Literature Novel Antigens |
| AWTAMTAATPIQIVG | Enolase | 166 | Literature Novel Antigens |
| DDLTVTNPTRIQTAI | Enolase | 181 | Literature Novel Antigens |
| NCLLLKVNQIGTVTE | Enolase | 201 | Literature Novel Antigens |
| LLLKVNQIGTVTESI | Enolase | 203 | Literature Novel Antigens |
| GTVTESIQAHTLAKA | Enolase | 211 | Literature Novel Antigens |
| VTESIQAHTLAKANG | Enolase | 213 | Literature Novel Antigens |
| NGWGTMVSHRSGETE | Enolase | 226 | Literature Novel Antigens |
| WGTMVSHRSGETEDS | Enolase | 228 | Literature Novel Antigens |
| ETEDSFIADLVVGLS | Enolase | 238 | Literature Novel Antigens |
| DSFIADLVVGLSTGQ | Enolase | 241 | Literature Novel Antigens |
| PCRSERLAKYNQILR | Enolase | 261 | Literature Novel Antigens |
| RLAKYNQILRIEEEL | Enolase | 266 | Literature Novel Antigens |
| AKYNQILRIEEELGD | Enolase | 268 | Literature Novel Antigens |
| NALLCCLLVSAASAI | NBGA1 | 26 | Novel antigens |
| ALLCCLLVSAASAIT | NBGA1 | 27 | Novel antigens |
| CLLVSAASAITPGWL | NBGA1 | 31 | Novel antigens |
| TPGWLPINSQLDYHV | NBGA1 | 41 | Novel antigens |
| PINSQLDYHVHGRTF | NBGA1 | 46 | Novel antigens |
| LDYHVHGRTFSSLFQ | NBGA1 | 51 | Novel antigens |
| HGRTFSSLFQVANQY | NBGA1 | 56 | Novel antigens |
| SSLFQVANQYTGILY | NBGA1 | 61 | Novel antigens |
| TGILYKARLSLDRNE | NBGA1 | 71 | Novel antigens |
| EKLHWDVVPMSQQPF | NBGA1 | 116 | Novel antigens |

TABLE 5-continued

Bla g Peptides Included in Epitope Screen. (SEQ ID NOs.: 257-1833)

| Sequence | Antigen | Position | Set |
|---|---|---|---|
| DVVPMSQQPFQIELN | NBGA1 | 121 | Novel antigens |
| SQQPFQIELNSRGEV | NBGA1 | 126 | Novel antigens |
| SRGEVRKLRVNKFVE | NBGA1 | 136 | Novel antigens |
| RKLRVNKFVELWEIN | NBGA1 | 141 | Novel antigens |
| NKFVELWEINMIKAI | NBGA1 | 146 | Novel antigens |
| LWEINMIKAIISQLQ | NBGA1 | 151 | Novel antigens |
| MIKAIISQLQVVVDE | NBGA1 | 156 | Novel antigens |
| ISQLQVVVDEDKKVY | NBGA1 | 161 | Novel antigens |
| DKKVYRVFESTVTGR | NBGA1 | 171 | Novel antigens |
| DTKLRIMKNHQFTNC | NBGA1 | 211 | Novel antigens |
| QFTNCRHNSAYKLHF | NBGA1 | 221 | Novel antigens |
| RHNSAYKLHFNAFEY | NBGA1 | 226 | Novel antigens |
| YKLHFNAFEYFHLKQ | NBGA1 | 231 | Novel antigens |
| FHLKQHKPETFLSNS | NBGA1 | 241 | Novel antigens |
| HKPETFLSNSAVSRV | NBGA1 | 246 | Novel antigens |
| FLSNSAVSRVIADGD | NBGA1 | 251 | Novel antigens |
| NLKNFTFYSGETIHK | NBGA1 | 266 | Novel antigens |
| TFYSGETIHKIVLNP | NBGA1 | 271 | Novel antigens |
| ETIHKIVLNPEIYNK | NBGA1 | 276 | Novel antigens |
| EIYNKQKGMLVSHIN | NBGA1 | 286 | Novel antigens |
| QKGMLVSHINVTVER | NBGA1 | 291 | Novel antigens |
| KGRELTVIDYELRNV | NBGA1 | 306 | Novel antigens |
| TVIDYELRNVGDLSY | NBGA1 | 311 | Novel antigens |
| GDLSYSTSLVKAHSM | NBGA1 | 321 | Novel antigens |
| STSLVKAHSMRNSAS | NBGA1 | 326 | Novel antigens |
| KAHSMRNSASMDLSS | NBGA1 | 331 | Novel antigens |
| SHNQKLSKKRQVPLP | NBGA1 | 376 | Novel antigens |
| LSKKRQVPLPRPLFE | NBGA1 | 381 | Novel antigens |
| QNPEIIPANLLPTYN | NBGA1 | 431 | Novel antigens |
| IPANLLPTYNLIHNT | NBGA1 | 436 | Novel antigens |
| LPTYNLIHNTKQVDV | NBGA1 | 441 | Novel antigens |
| DPVGVAVRLSKDIAA | NBGA1 | 456 | Novel antigens |
| AVRLSKDIAADLQGE | NBGA1 | 461 | Novel antigens |
| DRHILPRFTILVRLL | NBGA1 | 481 | Novel antigens |
| PRFTILVRLLKQLKV | NBGA1 | 486 | Novel antigens |
| LVRLLKQLKVSQIME | NBGA1 | 491 | Novel antigens |
| KQLKVSQIMEAARKL | NBGA1 | 496 | Novel antigens |
| SQIMEAARKLYKLEN | NBGA1 | 501 | Novel antigens |

TABLE 5-continued

Bla g Peptides Included in Epitope Screen. (SEQ ID NOs.: 257-1833)

| Sequence | Antigen | Position | Set |
|---|---|---|---|
| YKLENDHPNYMNWDT | NBGA1 | 511 | Novel antigens |
| AGTWSALNSIQQFIS | NBGA1 | 536 | Novel antigens |
| ALNSIQQFISSEMVE | NBGA1 | 541 | Novel antigens |
| QQFISSEMVEPKEAS | NBGA1 | 546 | Novel antigens |
| PKEASHLITVLPAAV | NBGA1 | 556 | Novel antigens |
| HLITVLPAAVSDKNK | NBGA1 | 561 | Novel antigens |
| AYLHFLFEMTKDPVF | NBGA1 | 576 | Novel antigens |
| LFEMTKDPVFKNMTY | NBGA1 | 581 | Novel antigens |
| KDPVFKNMTYVNTSL | NBGA1 | 586 | Novel antigens |
| KNMTYVNTSLVLAFS | NBGA1 | 591 | Novel antigens |
| VNTSLVLAFSEVIHQ | NBGA1 | 596 | Novel antigens |
| VLAFSEVIHQVEMHQ | NBGA1 | 601 | Novel antigens |
| EVIHQVEMHQVRDLK | NBGA1 | 606 | Novel antigens |
| VEMHQVRDLKIKSVY | NBGA1 | 611 | Novel antigens |
| VRDLKIKSVYIPYLV | NBGA1 | 616 | Novel antigens |
| IKSVYIPYLVQEFDD | NBGA1 | 621 | Novel antigens |
| QEFDDAVKENNSIKI | NBGA1 | 631 | Novel antigens |
| AVKENNSIKIQLYTH | NBGA1 | 636 | Novel antigens |
| NSIKIQLYTHALGVT | NBGA1 | 641 | Novel antigens |
| QLYTHALGVTGNTHI | NBGA1 | 646 | Novel antigens |
| ALGVTGNTHILHYLR | NBGA1 | 651 | Novel antigens |
| GNTHILHYLRPYIIQ | NBGA1 | 656 | Novel antigens |
| LHYLRPYIIQLKTIT | NBGA1 | 661 | Novel antigens |
| PYIIQLKTITHHQRL | NBGA1 | 666 | Novel antigens |
| LKTITHHQRLFMVQS | NBGA1 | 671 | Novel antigens |
| HHQRLFMVQSLERVV | NBGA1 | 676 | Novel antigens |
| FMVQSLERVVEHNPR | NBGA1 | 681 | Novel antigens |
| LERVVEHNPRKVIDL | NBGA1 | 686 | Novel antigens |
| KVIDLLLSLYLDQNE | NBGA1 | 696 | Novel antigens |
| LLSLYLDQNEHADIR | NBGA1 | 701 | Novel antigens |
| HADIRVEALFLLMKA | NBGA1 | 711 | Novel antigens |
| VEALFLLMKADPSIH | NBGA1 | 716 | Novel antigens |
| LLMKADPSIHVLKMV | NBGA1 | 721 | Novel antigens |
| DPSIHVLKMVAELTH | NBGA1 | 726 | Novel antigens |
| VLKMVAELTHTESNN | NBGA1 | 731 | Novel antigens |
| QVLSASQSAIKSAAN | NBGA1 | 746 | Novel antigens |
| YSEMRRKAKAVEHLL | NBGA1 | 766 | Novel antigens |

TABLE 5-continued

Bla g Peptides Included in Epitope Screen. (SEQ ID NOs.: 257-1833)

| Sequence | Antigen | Position | Set |
|---|---|---|---|
| VEHLLSTRNMDVSYS | NBGA1 | 776 | Novel antigens |
| STRNMDVSYSKSYLY | NBGA1 | 781 | Novel antigens |
| DVSYSKSYLYGYKSK | NBGA1 | 786 | Novel antigens |
| KSYLYGYKSKKINYD | NBGA1 | 791 | Novel antigens |
| GYKSKKINYDSLYNL | NBGA1 | 796 | Novel antigens |
| KINYDSLYNLNNIGS | NBGA1 | 801 | Novel antigens |
| EDSIYPKSMLLNIFT | NBGA1 | 816 | Novel antigens |
| PKSMLLNIFTNNLGR | NBGA1 | 821 | Novel antigens |
| LNIFTNNLGRINTHV | NBGA1 | 826 | Novel antigens |
| QKGYMVSSMTDLWEA | NBGA1 | 841 | Novel antigens |
| DLWEAFHTIYKKDNG | NBGA1 | 851 | Novel antigens |
| KTLVKFVEGNLKYFN | NBGA1 | 871 | Novel antigens |
| LKYFNMGVQKFWAFD | NBGA1 | 881 | Novel antigens |
| MGVQKFWAFDNTTFS | NBGA1 | 886 | Novel antigens |
| FWAFDNTTFSNASAV | NBGA1 | 891 | Novel antigens |
| NTTFSNASAVIQEFL | NBGA1 | 896 | Novel antigens |
| NASAVIQEFLKTYKK | NBGA1 | 901 | Novel antigens |
| IQEFLKTYKKPTNFN | NBGA1 | 906 | Novel antigens |
| PTNFNHTKLSSSSSI | NBGA1 | 916 | Novel antigens |
| HTKLSSSSSITLTLP | NBGA1 | 921 | Novel antigens |
| SSSSITLTLPCAMGL | NBGA1 | 926 | Novel antigens |
| PAYFKMNSPSLWKYN | NBGA1 | 941 | Novel antigens |
| MNSPSLWKYNGEFSI | NBGA1 | 946 | Novel antigens |
| GEFSIQTDAKTDVPM | NBGA1 | 956 | Novel antigens |
| TDVPMSLENFMNITG | NBGA1 | 966 | Novel antigens |
| SLENFMNITGSINLM | NBGA1 | 971 | Novel antigens |
| MNITGSINLMFSQMY | NBGA1 | 976 | Novel antigens |
| SINLMFSQMYHAQLA | NBGA1 | 981 | Novel antigens |
| FSQMYHAQLAFSTAF | NBGA1 | 986 | Novel antigens |
| RKVEVHVPVKFQINL | NBGA1 | 1011 | Novel antigens |
| HVPVKFQINLDFKNH | NBGA1 | 1016 | Novel antigens |
| FQINLDFKNHNGFIR | NBGA1 | 1021 | Novel antigens |
| DFKNHNGFIRIIPLF | NBGA1 | 1026 | Novel antigens |
| NGFIRIIPLFTDRDY | NBGA1 | 1031 | Novel antigens |
| DVLQWQTIPYTTIHN | NBGA1 | 1046 | Novel antigens |
| QTIPYTTIHNVPDFE | NBGA1 | 1051 | Novel antigens |
| RLFHTQPSITYQTLK | NBGA1 | 1051 | Novel antigens |
| VPDFETVYMDQLFKL | NBGA1 | 1061 | Novel antigens |

TABLE 5-continued

Bla g Peptides Included in Epitope Screen. (SEQ ID NOs.: 257-1833)

| Sequence | Antigen | Position | Set |
|---|---|---|---|
| YQTLKQSTWINYFKL | NBGA1 | 1061 | Novel antigens |
| TVYMDQLFKLIHVRK | NBGA1 | 1066 | Novel antigens |
| QSTWINYFKLIHVRK | NBGA1 | 1066 | Novel antigens |
| QLFKLIHVRKTAHFE | NBGA1 | 1071 | Novel antigens |
| NYFKLIHVRKTAHFE | NBGA1 | 1071 | Novel antigens |
| IHVRKTAHFEKKMGE | NBGA1 | 1076 | Novel antigens |
| NTGIVFKVKYDTDQE | NBGA1 | 1091 | Novel antigens |
| FKVKYDTDQEFLDTK | NBGA1 | 1096 | Novel antigens |
| FLDTKWFLDEFKVLQ | NBGA1 | 1106 | Novel antigens |
| WFLDEFKVLQLFTGL | NBGA1 | 1111 | Novel antigens |
| FKVLQLFTGLNYDVP | NBGA1 | 1116 | Novel antigens |
| TKDIFYNNLTVYYDH | NBGA1 | 1131 | Novel antigens |
| YIMIMKTPKTIAVSF | NBGA1 | 1141 | Novel antigens |
| QSKFYETLNPVVQQN | NBGA1 | 1161 | Novel antigens |
| ETLNPVVQQNLKLSS | NBGA1 | 1166 | Novel antigens |
| VVQQNLKLSSGKKQK | NBGA1 | 1171 | Novel antigens |
| HRNVKSHRIRREYTE | NBGA1 | 1186 | Novel antigens |
| PRRQEYLSKSMALTG | NBGA1 | 1216 | Novel antigens |
| YLSKSMALTGDATAV | NBGA1 | 1221 | Novel antigens |
| DATAVVLDMTLKFEG | NBGA1 | 1231 | Novel antigens |
| PAESYFTTTVSHATS | NBGA1 | 1246 | Novel antigens |
| FTTTVSHATSLVNGS | NBGA1 | 1251 | Novel antigens |
| SHATSLVNGSSNYLL | NBGA1 | 1256 | Novel antigens |
| LVNGSSNYLLFYDQH | NBGA1 | 1261 | Novel antigens |
| SNYLLFYDQHYYEEK | NBGA1 | 1266 | Novel antigens |
| KRNQFCLSWSVYKPQ | NBGA1 | 1281 | Novel antigens |
| CLSWSVYKPQVPIMN | NBGA1 | 1286 | Novel antigens |
| VYKPQVPIMNIYSAF | NBGA1 | 1291 | Novel antigens |
| VPIMNIYSAFEFDPN | NBGA1 | 1296 | Novel antigens |
| IYSAFEFDPNSKVHA | NBGA1 | 1301 | Novel antigens |
| SKVHAIMNIGKECEN | NBGA1 | 1311 | Novel antigens |
| GGSAVANIDMLRLSE | NBGA1 | 1326 | Novel antigens |
| ANIDMLRLSEHLDYV | NBGA1 | 1331 | Novel antigens |
| LRLSEHLDYVKNLTV | NBGA1 | 1336 | Novel antigens |
| HLDYVKNLTVSKLCD | NBGA1 | 1341 | Novel antigens |
| ASDLNRVHVDINYNL | NBGA1 | 1376 | Novel antigens |
| RVHVDINYNLKQHET | NBGA1 | 1381 | Novel antigens |

TABLE 5-continued

Bla g Peptides Included in Epitope
Screen. (SEQ ID NOs.: 257-1833)

| Sequence | Antigen | Position | Set |
|---|---|---|---|
| FKRRVYKVYDFVRTH | NBGA1 | 1396 | Novel antigens |
| YKVYDFVRTHLYPHV | NBGA1 | 1401 | Novel antigens |
| FVRTHLYPHVSEDVI | NBGA1 | 1406 | Novel antigens |
| SEDVIVDNPAQFISA | NBGA1 | 1416 | Novel antigens |
| VDNPAQFISANFTLK | NBGA1 | 1421 | Novel antigens |
| QFISANFTLKDNTRA | NBGA1 | 1426 | Novel antigens |
| NFTLKDNTRAFNVSI | NBGA1 | 1431 | Novel antigens |
| DNTRAFNVSIKTPVL | NBGA1 | 1436 | Novel antigens |
| FNVSIKTPVLSVNAT | NBGA1 | 1441 | Novel antigens |
| KTPVLSVNATVVRLQ | NBGA1 | 1446 | Novel antigens |
| ETPVLSVNATSVRLQ | NBGA1 | 1446 | Novel antigens |
| SVNATVVRLQSWQSE | NBGA1 | 1451 | Novel antigens |
| VVRLQSWQSEMLRMN | NBGA1 | 1456 | Novel antigens |
| SWQSEMLRMNPRTSF | NBGA1 | 1461 | Novel antigens |
| MLRMNPRTSFAKRFA | NBGA1 | 1466 | Novel antigens |
| AKRFAKWALPLYNKP | NBGA1 | 1476 | Novel antigens |
| SSYINTFDNFTYSAH | NBGA1 | 1496 | Novel antigens |
| TFDNFTYSAHHIVQN | NBGA1 | 1501 | Novel antigens |
| TYSAHHIVQNDAFYT | NBGA1 | 1506 | Novel antigens |
| HIVQNDAFYTILDIP | NBGA1 | 1511 | Novel antigens |
| DAFYTILDIPQKFNM | NBGA1 | 1516 | Novel antigens |
| QKFNMEYFKVAFKPT | NBGA1 | 1526 | Novel antigens |
| EYFKVAFKPTSPVPN | NBGA1 | 1531 | Novel antigens |
| MQREVLVFLRNAKIE | NBGA1 | 1546 | Novel antigens |
| LVFLRNAKIELKPNQ | NBGA1 | 1551 | Novel antigens |
| DLNVSQDRIGYVYAF | NBGA1 | 1586 | Novel antigens |
| QDRIGYVYALPTKAA | NBGA1 | 1591 | Novel antigens |
| YVYALPTKAAHIVFP | NBGA1 | 1596 | Novel antigens |
| HIVFPSYEIEMFYDG | NBGA1 | 1606 | Novel antigens |
| SYEIEMFYDGSRIMI | NBGA1 | 1611 | Novel antigens |
| MFYDGSRIMIQASNM | NBGA1 | 1616 | Novel antigens |
| SRIMIQASNMYRNFT | NBGA1 | 1621 | Novel antigens |
| QASNMYRNFTKGLLW | NBGA1 | 1626 | Novel antigens |
| LTPWGCYAKDMALFV | NBGA1 | 1651 | Novel antigens |
| CYAKDMALFVASYAD | NBGA1 | 1656 | Novel antigens |
| MALFVASYADNSNSE | NBGA1 | 1661 | Novel antigens |
| LVSHQMRLSQVIKLA | NBGA1 | 1696 | Novel antigens |
| GVLVFTKENFKKGVS | NBGA10 | 16 | Novel antigens |

TABLE 5-continued

Bla g Peptides Included in Epitope Screen. (SEQ ID NOs.: 257-1833)

| Sequence | Antigen | Position | Set |
|---|---|---|---|
| DNEFVLVEFYAPWCG | NBGA10 | 31 | Novel antigens |
| PTLKFFRSGSPIDYS | NBGA10 | 91 | Novel antigens |
| DEIVSWLLKKTGPVA | NBGA10 | 111 | Novel antigens |
| VDDAKSFIDASNVAI | NBGA10 | 131 | Novel antigens |
| SFIDASNVAIIGFFK | NBGA10 | 136 | Novel antigens |
| AAKNFLAAANAIDDY | NBGA10 | 156 | Novel antigens |
| PQIEVTFEIDANGIL | NBGA11 | 31 | Novel antigens |
| TFEIDANGILQVSAE | NBGA11 | 36 | Novel antigens |
| LESYAYSLKNQLADK | NBGA11 | 101 | Novel antigens |
| KKELEDIVQPIIAKL | NBGA11 | 156 | Novel antigens |
| DIVQPIIAKLYQGAG | NBGA11 | 161 | Novel antigens |
| LELGALLTAMAMVTA | NBGA12 | 16 | Novel antigens |
| LLTAMAMVTAKLATV | NBGA12 | 21 | Novel antigens |
| STDSTLVYKIQPVNN | NBGA12 | 71 | Novel antigens |
| LVYKIQPVNNAHGGG | NBGA12 | 76 | Novel antigens |
| ASYFKSNCPDAYSYA | NBGA12 | 151 | Novel antigens |
| SSLEVFFQQQRILLR | NBGA13 | 1 | Novel antigens |
| FFQQQRILLRLHRCF | NBGA13 | 6 | Novel antigens |
| RILLRLHRCFQVLGR | NBGA13 | 11 | Novel antigens |
| WGGDVAFVKHLTALE | NBGA13 | 26 | Novel antigens |
| AFVKHLTALENTDGH | NBGA13 | 31 | Novel antigens |
| NQLNEIRHAILAAGD | NBGA13 | 96 | Novel antigens |
| IRHAILAAGDLYSRR | NBGA13 | 101 | Novel antigens |
| DGTKDLLFKNSATGL | NBGA13 | 126 | Novel antigens |
| KDLLFKNSATGLLSV | NBGA13 | 129 | Novel antigens |
| KHCLQMASNTMPYQI | NBGA14 | 16 | Novel antigens |
| MPYQIASGFSTSQLA | NBGA14 | 26 | Novel antigens |
| ASGFSTSQLAMIQNA | NBGA14 | 31 | Novel antigens |
| TSQLAMIQNAIDEYH | NBGA14 | 36 | Novel antigens |
| ERDDYVTIHWENIQS | NBGA14 | 121 | Novel antigens |
| YGKIIKRLEAKGFKL | NBGA15 | 1 | Novel antigens |
| KGFKLVAMKFVWADE | NBGA15 | 11 | Novel antigens |
| VAMKFVWADEELLKK | NBGA15 | 16 | Novel antigens |
| FPGLVKYMSSGPVVP | NBGA15 | 41 | Novel antigens |
| MVWEGLNVVKTGRLM | NBGA15 | 56 | Novel antigens |
| LNVVKTGRLMLGATD | NBGA15 | 61 | Novel antigens |
| STRMELQHLQSIEVF | NBGA16 | 1 | Novel antigens |

TABLE 5-continued

Bla g Peptides Included in Epitope Screen. (SEQ ID NOs.: 257-1833)

| Sequence | Antigen | Position | Set |
|---|---|---|---|
| LQHLQSIEVFPEDEG | NBGA16 | 6 | Novel antigens |
| ILSCRIIGAQKFDVV | NBGA16 | 76 | Novel antigens |
| SKDFQYTNEANIYKL | NBGA16 | 101 | Novel antigens |
| YTNEANIYKLNIAEI | NBGA16 | 106 | Novel antigens |
| NIYKLNIAEIFPEDS | NBGA16 | 111 | Novel antigens |
| LILATAALAVAYPSP | NBGA2 | 5 | Novel antigens |
| ILATAALAVAYPSPG | NBGA2 | 6 | Novel antigens |
| QDYKVLADKTYLTRQ | NBGA2 | 21 | Novel antigens |
| LADKTYLTRQRDLLK | NBGA2 | 26 | Novel antigens |
| YLTRQRDLLKLLVRI | NBGA2 | 31 | Novel antigens |
| RDLLKLLVRIQQPNY | NBGA2 | 36 | Novel antigens |
| LLVRIQQPNYYADQY | NBGA2 | 41 | Novel antigens |
| YADQYEIGQSYDIEA | NBGA2 | 51 | Novel antigens |
| YDIEANINNYKYPYV | NBGA2 | 61 | Novel antigens |
| NINNYKYPYVVKNFV | NBGA2 | 66 | Novel antigens |
| KYPYVVKNFVAAYKN | NBGA2 | 71 | Novel antigens |
| VKNFVAAYKNGMLAR | NBGA2 | 76 | Novel antigens |
| PYYTTQSYETKLLFD | NBGA2 | 96 | Novel antigens |
| QSYETKLLFDLFYYA | NBGA2 | 101 | Novel antigens |
| KLLFDLFYYANDYDT | NBGA2 | 106 | Novel antigens |
| LFYYANDYDTFYKTA | NBGA2 | 111 | Novel antigens |
| HINEGQFLYALSSAL | NBGA2 | 131 | Novel antigens |
| QFLYALSSALFQRED | NBGA2 | 136 | Novel antigens |
| LNDYILPAPYEIYPW | NBGA2 | 151 | Novel antigens |
| EIYPWLFVDSDVIQR | NBGA2 | 161 | Novel antigens |
| LFVDSDVIQRAYETR | NBGA2 | 166 | Novel antigens |
| DVIQRAYETRMSDVH | NBGA2 | 171 | Novel antigens |
| MSDVHLTAPKTYIFP | NBGA2 | 181 | Novel antigens |
| LTAPKTYIFPVNYTV | NBGA2 | 186 | Novel antigens |
| TYIFPVNYTVHTPEQ | NBGA2 | 191 | Novel antigens |
| ELNYFYHDVGLNTYY | NBGA2 | 206 | Novel antigens |
| YHDVGLNTYYSYYYF | NBGA2 | 211 | Novel antigens |
| LNTYYSYYYFNYPTF | NBGA2 | 216 | Novel antigens |
| SYYYFNYPTFFNSTE | NBGA2 | 221 | Novel antigens |
| NYPTFFNSTEYGVQF | NBGA2 | 226 | Novel antigens |
| DRRGEMFYYTRQQLY | NBGA2 | 241 | Novel antigens |
| PRHGEQFYYFQQIY | NBGA2 | 241 | Novel antigens |
| MFYYTRQQLYARYFL | NBGA2 | 246 | Novel antigens |

TABLE 5-continued

Bla g Peptides Included in Epitope Screen. (SEQ ID NOs.: 257-1833)

| Sequence | Antigen | Position | Set |
|---|---|---|---|
| QFYYFYQQIYARYML | NBGA2 | 246 | Novel antigens |
| RQQLYARYFLERLSN | NBGA2 | 251 | Novel antigens |
| YQQIYARYMLERYSN | NBGA2 | 251 | Novel antigens |
| ARYFLERLSNDLPDV | NBGA2 | 256 | Novel antigens |
| EPLHYDRPFQTEYNP | NBGA2 | 271 | Novel antigens |
| KPFTYNKAFKTPYNP | NBGA2 | 271 | Novel antigens |
| DRPFQTEYNPQLRYP | NBGA2 | 276 | Novel antigens |
| NKAFKTPYNPQLRYP | NBGA2 | 276 | Novel antigens |
| PVRPYEYSRRSLYYS | NBGA2 | 296 | Novel antigens |
| PARPAYMVPQDFDLY | NBGA2 | 296 | Novel antigens |
| EYSRRSLYYSNGYSH | NBGA2 | 301 | Novel antigens |
| SLYYSNGYSHYYGNY | NBGA2 | 306 | Novel antigens |
| NYYTGDYHPSYYYGY | NBGA2 | 331 | Novel antigens |
| DYHPSYYYGYATQYD | NBGA2 | 336 | Novel antigens |
| YYYGYATQYDYYYPE | NBGA2 | 341 | Novel antigens |
| ATQYDYYYPEDLQSY | NBGA2 | 346 | Novel antigens |
| YYYPEDLQSYERRVR | NBGA2 | 351 | Novel antigens |
| GYFFGFQGEKYPLYE | NBGA2 | 371 | Novel antigens |
| FQGEKYPLYENYIKG | NBGA2 | 376 | Novel antigens |
| YPLYENYIKGIDYLG | NBGA2 | 381 | Novel antigens |
| NQRFYGSIYHYYRQL | NBGA2 | 406 | Novel antigens |
| GSIYHYYRQLAGKSV | NBGA2 | 411 | Novel antigens |
| YYRQLAGKSVDPYNN | NBGA2 | 416 | Novel antigens |
| DPYNNYGLAPSALQN | NBGA2 | 426 | Novel antigens |
| YGLAPSALQNIYTTL | NBGA2 | 431 | Novel antigens |
| SALQNIYTTLRDPAN | NBGA2 | 436 | Novel antigens |
| RDPANWQILKRVNYL | NBGA2 | 446 | Novel antigens |
| WQILKRVNYLFQRYK | NBGA2 | 451 | Novel antigens |
| RVNYLFQRYKGYLPR | NBGA2 | 456 | Novel antigens |
| EHFDVDLDNVVNVKV | NBGA2 | 496 | Novel antigens |
| AEDGKYIDYRARQTR | NBGA2 | 511 | Novel antigens |
| YIDYRARQTRLNHKP | NBGA2 | 516 | Novel antigens |
| QATDAYVRVFLGPKY | NBGA2 | 541 | Novel antigens |
| YVRVFLGPKYDYLHS | NBGA2 | 546 | Novel antigens |
| DRRHYFVEIDRFPYK | NBGA2 | 566 | Novel antigens |
| FVEIDRFPYKVQAGK | NBGA2 | 571 | Novel antigens |
| RFPYKVQAGKTTITR | NBGA2 | 576 | Novel antigens |

TABLE 5-continued

Bla g Peptides Included in Epitope Screen. (SEQ ID NOs.: 257-1833)

| Sequence | Antigen | Position | Set |
|---|---|---|---|
| SVVSPDYQSYRTLMR | NBGA2 | 596 | Novel antigens |
| DYQSYRTLMRKVYDA | NBGA2 | 601 | Novel antigens |
| RTLMRKVYDAYEGKD | NBGA2 | 606 | Novel antigens |
| YEGKDQFYYDKSEQY | NBGA2 | 616 | Novel antigens |
| QFYYDKSEQYCGYPE | NBGA2 | 621 | Novel antigens |
| GQEYTFYVIVTPYAK | NBGA2 | 646 | Novel antigens |
| FYVIVTPYAKQDDHD | NBGA2 | 651 | Novel antigens |
| YKSFSYCGVGANHRI | NBGA2 | 671 | Novel antigens |
| SHDFVTPNMYFKDVV | NBGA2 | 701 | Novel antigens |
| TPNMYFKDVVIYHKK | NBGA2 | 706 | Novel antigens |
| FSNMDIKGKNALVTG | NBGA3 | 1 | Novel antigens |
| AATGIGLEYVKQLLE | NBGA3 | 16 | Novel antigens |
| GLEYVKQLLENGAQH | NBGA3 | 21 | Novel antigens |
| KQLLENGAQHVAVCD | NBGA3 | 26 | Novel antigens |
| KELVEKYGKGKAIFI | NBGA3 | 51 | Novel antigens |
| KAIFIKCDVTNIPEF | NBGA3 | 61 | Novel antigens |
| EDAFKKAYNAFKSLD | NBGA3 | 76 | Novel antigens |
| KAYNAFKSLDIVINN | NBGA3 | 81 | Novel antigens |
| FKSLDIVINNAGILN | NBGA3 | 86 | Novel antigens |
| IVINNAGILNDEKWE | NBGA3 | 91 | Novel antigens |
| DEKWELQIAINVNGV | NBGA3 | 101 | Novel antigens |
| LQIAINVNGVVRGTL | NBGA3 | 106 | Novel antigens |
| GGKGGVIVNIASILG | NBGA3 | 131 | Novel antigens |
| VIVNIASILGLQNMA | NBGA3 | 136 | Novel antigens |
| ASILGLQNMAGCPVY | NBGA3 | 141 | Novel antigens |
| GCPVYVGTKHAVVGI | NBGA3 | 151 | Novel antigens |
| AVVGISRSFGMPFHF | NBGA3 | 161 | Novel antigens |
| MPFHFDRTGVRVLTM | NBGA3 | 171 | Novel antigens |
| DRTGVRVLTMCPGVT | NBGA3 | 176 | Novel antigens |
| AKGMMHMIKKGANGS | NBGA3 | 226 | Novel antigens |
| GNKPVYEVAIPDRLT | NBGA3 | 246 | Novel antigens |
| VYEVAIPDRLTLRVE | NBGA3 | 250 | Novel antigens |
| AGVLWVCATGMARQV | NBGA4 | 11 | Novel antigens |
| QTLFLLLLLLAAVSA | NBGA4 | 31 | Novel antigens |
| LLLLLAAVSASQQCK | NBGA4 | 36 | Novel antigens |
| AGNTYVYSFEGGTTT | NBGA4 | 66 | Novel antigens |
| QGDGVKLHLKAKAEV | NBGA4 | 86 | Novel antigens |
| THLNDLESHPVSFSF | NBGA4 | 126 | Novel antigens |

TABLE 5-continued

Bla g Peptides Included in Epitope Screen. (SEQ ID NOs.: 257-1833)

| Sequence | Antigen | Position | Set |
|---|---|---|---|
| SEASLNLKRAILAHF | NBGA4 | 156 | Novel antigens |
| NLKRAILAHFQVAPQ | NBGA4 | 161 | Novel antigens |
| ILAHFQVAPQETARS | NBGA4 | 166 | Novel antigens |
| RGGTTTITKSRNLNK | NBGA4 | 201 | Novel antigens |
| CHLREHLRQDFASVT | NBGA4 | 216 | Novel antigens |
| HLRQDFASVTYHVES | NBGA4 | 221 | Novel antigens |
| FASVTYHVESDLQNS | NBGA4 | 226 | Novel antigens |
| TQEFKHQLQGGVLRV | NBGA4 | 246 | Novel antigens |
| KYLYRPFANQDAGAK | NBGA4 | 266 | Novel antigens |
| DAGAKTVVDSKLTYV | NBGA4 | 276 | Novel antigens |
| QSIIFHPPNVHPGSG | NBGA4 | 306 | Novel antigens |
| KEFANVVRVVRHTSK | NBGA4 | 346 | Novel antigens |
| VVRVVRHTSKNDLLS | NBGA4 | 351 | Novel antigens |
| NDLLSVYNQVKSGAG | NBGA4 | 361 | Novel antigens |
| FKDKSAGTKMFLDAL | NBGA4 | 376 | Novel antigens |
| AGTKMFLDALFRAGT | NBGA4 | 381 | Novel antigens |
| VAVELLKSNKITGPH | NBGA4 | 401 | Novel antigens |
| AEFYYLQLAYTRHVT | NBGA4 | 416 | Novel antigens |
| LQLAYTRHVTKAALL | NBGA4 | 421 | Novel antigens |
| TRHVTKAALLAAVTL | NBGA4 | 426 | Novel antigens |
| KAALLAAVTLLEQPN | NBGA4 | 431 | Novel antigens |
| AAVTLLEQPNPSKLA | NBGA4 | 436 | Novel antigens |
| AEVDEFLEKLSLLLN | NBGA4 | 471 | Novel antigens |
| FLEKLSLLLNGGCKV | NBGA4 | 476 | Novel antigens |
| SLLLNGGCKVSNYDE | NBGA4 | 481 | Novel antigens |
| SNYDEEVKIVATLKA | NBGA4 | 491 | Novel antigens |
| EVKIVATLKALQNAH | NBGA4 | 496 | Novel antigens |
| ATLKALQNAHHLNDA | NBGA4 | 501 | Novel antigens |
| HLNDAVTSKLQTCLL | NBGA4 | 511 | Novel antigens |
| DDGVPTRIRSAVLDV | NBGA4 | 526 | Novel antigens |
| CKAKDISLEVLKNYQ | NBGA4 | 546 | Novel antigens |
| ISLEVLKNYQLDSEL | NBGA4 | 551 | Novel antigens |
| LKNYQLDSELRIKAF | NBGA4 | 556 | Novel antigens |
| LDSELRIKAFLALVE | NBGA4 | 561 | Novel antigens |
| RIKAFLALVECPCNK | NBGA4 | 566 | Novel antigens |
| KELLDKEPSYQVGSF | NBGA4 | 586 | Novel antigens |
| KEPSYQVGSFIVSYL | NBGA4 | 591 | Novel antigens |

TABLE 5-continued

Bla g Peptides Included in Epitope
Screen. (SEQ ID NOs.: 257-1833)

| Sequence | Antigen | Position | Set |
|---|---|---|---|
| QVGSFIVSYLRNLRA | NBGA4 | 596 | Novel antigens |
| IVSYLRNLRASANPS | NBGA4 | 601 | Novel antigens |
| RNLRASANPSKEKQK | NBGA4 | 606 | Novel antigens |
| AVFGEIRTTKRFPID | NBGA4 | 621 | Novel antigens |
| IRTTKRFPIDFRKFS | NBGA4 | 626 | Novel antigens |
| RFPIDFRKFSNNFEF | NBGA4 | 631 | Novel antigens |
| FRKFSNNFEFSYLLG | NBGA4 | 636 | Novel antigens |
| NNFEFSYLLGGANVG | NBGA4 | 641 | Novel antigens |
| TTVESNVIYSQNSFL | NBGA4 | 656 | Novel antigens |
| NVIYSQNSFLPRATT | NBGA4 | 661 | Novel antigens |
| LNLTTEFFGHSVNLL | NBGA4 | 676 | Novel antigens |
| EFFGHSVNLLEVELR | NBGA4 | 681 | Novel antigens |
| GYFNTHTAAEVVQKG | NBGA4 | 711 | Novel antigens |
| DVENTAKQRFNHAIR | NBGA4 | 731 | Novel antigens |
| AKQRFNHAIRGKRSV | NBGA4 | 736 | Novel antigens |
| NHAIRGKRSVTKEQL | NBGA4 | 741 | Novel antigens |
| TKEQLELVKSKSVSP | NBGA4 | 751 | Novel antigens |
| ELVKSKSVSPYHSET | NBGA4 | 756 | Novel antigens |
| DRELLLELSTRLFGA | NBGA4 | 771 | Novel antigens |
| RLFGAEVGWLALHHN | NBGA4 | 781 | Novel antigens |
| EVGWLALHHNARDAA | NBGA4 | 786 | Novel antigens |
| TTFNLLDKVMKKAKD | NBGA4 | 806 | Novel antigens |
| FDYKLRQHNTFLDTE | NBGA4 | 821 | Novel antigens |
| FLDTELVYPTSLGFP | NBGA4 | 831 | Novel antigens |
| LVYPTSLGFPLKLVL | NBGA4 | 836 | Novel antigens |
| SLGFPLKLVLAGSSA | NBGA4 | 841 | Novel antigens |
| LKLVLAGSSAVHVEL | NBGA4 | 846 | Novel antigens |
| VHDLVHNLKNSHVHF | NBGA4 | 866 | Novel antigens |
| HNLKNSHVHFRFVPS | NBGA4 | 871 | Novel antigens |
| SHVHFRFVPSAAVEF | NBGA4 | 876 | Novel antigens |
| RFVPSAAVEFVGAFV | NBGA4 | 881 | Novel antigens |
| AAVEFVGAFVVDAYA | NBGA4 | 886 | Novel antigens |
| VGAFVVDAYAVEAGL | NBGA4 | 891 | Novel antigens |
| VDAYAVEAGLKVAAT | NBGA4 | 896 | Novel antigens |
| VEAGLKVAATLHTAT | NBGA4 | 901 | Novel antigens |
| KVAATLHTATGSDIT | NBGA4 | 906 | Novel antigens |
| DVGVDVTVGLPVQKQ | NBGA4 | 926 | Novel antigens |
| PVQKQDIVTLKTEVL | NBGA4 | 936 | Novel antigens |

TABLE 5-continued

Bla g Peptides Included in Epitope Screen. (SEQ ID NOs.: 257-1833)

| Sequence | Antigen | Position | Set |
|---|---|---|---|
| DIVTLKTEVLTTVQE | NBGA4 | 941 | Novel antigens |
| HGCFDQLSPLVGLTF | NBGA4 | 976 | Novel antigens |
| VGLTFCTTMSFPWDP | NBGA4 | 986 | Novel antigens |
| FPWDPVASKAAFYPL | NBGA4 | 996 | Novel antigens |
| AFYPLNGPSKFSLVV | NBGA4 | 1006 | Novel antigens |
| TSYHFRASLNKADPH | NBGA4 | 1026 | Novel antigens |
| KKSLELLLETPGSKT | NBGA4 | 1041 | Novel antigens |
| ERKLGLILERTYDPY | NBGA4 | 1056 | Novel antigens |
| TYDPYHGVKAQLNSP | NBGA4 | 1066 | Novel antigens |
| HGVKAQLNSPWKQVS | NBGA4 | 1071 | Novel antigens |
| QLNSPWKQVSAELAF | NBGA4 | 1076 | Novel antigens |
| DEQEYYVKLGASVTG | NBGA4 | 1106 | Novel antigens |
| THQFNVAGSVTVDKT | NBGA4 | 1156 | Novel antigens |
| TDLKVYYGENHVVLK | NBGA4 | 1206 | Novel antigens |
| YYGENHVVLKSGFKR | NBGA4 | 1211 | Novel antigens |
| HVVLKSGFKRPSANN | NBGA4 | 1216 | Novel antigens |
| QYPDFGVNLIWNHKR | NBGA4 | 1241 | Novel antigens |
| GVNLIWNHKRDKNNF | NBGA4 | 1246 | Novel antigens |
| DKNNFGNSLAVVHGR | NBGA4 | 1256 | Novel antigens |
| EARFTLNQEAHYQFD | NBGA4 | 1276 | Novel antigens |
| LNQEAHYQFDSIHKF | NBGA4 | 1281 | Novel antigens |
| HYQFDSIHKFEFASK | NBGA4 | 1286 | Novel antigens |
| SIHKFEFASKNKVTY | NBGA4 | 1291 | Novel antigens |
| EFASKNKVTYPLLGI | NBGA4 | 1296 | Novel antigens |
| PLLGIIGKLDASVQP | NBGA4 | 1306 | Novel antigens |
| KTFHLDVEASYEKHK | NBGA4 | 1321 | Novel antigens |
| RVIVSEGKSKFTTEL | NBGA4 | 1371 | Novel antigens |
| NNIDFQIDAEAKIHG | NBGA4 | 1406 | Novel antigens |
| QPDPYKLDSGLVYNP | NBGA4 | 1421 | Novel antigens |
| KLDSGLVYNPQLFDA | NBGA4 | 1426 | Novel antigens |
| KVFLKNYLVGNAQFK | NBGA4 | 1471 | Novel antigens |
| NYLVGNAQFKYTNGE | NBGA4 | 1476 | Novel antigens |
| GSATLNVDVPKLGRK | NBGA4 | 1491 | Novel antigens |
| DLHVKGSQHVATVEL | NBGA4 | 1511 | Novel antigens |
| GSQHVATVELYYNAE | NBGA4 | 1516 | Novel antigens |
| ATVELYYNAEKKLAF | NBGA4 | 1521 | Novel antigens |
| YYNAEKKLAFHTDTD | NBGA4 | 1526 | Novel antigens |

TABLE 5-continued

Bla g Peptides Included in Epitope Screen. (SEQ ID NOs.: 257-1833)

| Sequence | Antigen | Position | Set |
|---|---|---|---|
| KKLAFHTDTDLKKDS | NBGA4 | 1531 | Novel antigens |
| LDSKNVLSILNYKTE | NBGA4 | 1546 | Novel antigens |
| VLSILNYKTEVNVKG | NBGA4 | 1551 | Novel antigens |
| YTGPFSVDNVLEFKL | NBGA5 | 16 | Novel antigens |
| KKLQFTYSESLDLDD | NBGA5 | 51 | Novel antigens |
| SSGKASYESFQNFRV | NBGA5 | 246 | Novel antigens |
| SYESFQNFRVEADIE | NBGA5 | 251 | Novel antigens |
| LKKWHVLLANKPQAK | NBGA5 | 271 | Novel antigens |
| LKADVFFNKFNPTDN | NBGA5 | 336 | Novel antigens |
| RQPLSFDHAVELKLL | NBGA5 | 436 | Novel antigens |
| TYNFHSYLNEKALGV | NBGA5 | 456 | Novel antigens |
| KALGVILTLPQRIIA | NBGA5 | 466 | Novel antigens |
| KAAVHLLVAVKASKE | NBGA5 | 511 | Novel antigens |
| DGASYISTLAYQDEK | NBGA5 | 616 | Novel antigens |
| AQIQVVIHLDEQYIY | NBGA5 | 636 | Novel antigens |
| EQYIYVKSPTAELIK | NBGA5 | 646 | Novel antigens |
| SKAVYYKKILPTRSS | NBGA5 | 696 | Novel antigens |
| YKKILPTRSSPLISC | NBGA5 | 701 | Novel antigens |
| IESIRKQTAIEIEQL | NBGA6 | 96 | Novel antigens |
| KQTAIEIEQLNARVV | NBGA6 | 101 | Novel antigens |
| KLQIQITELEMSLDV | NBGA6 | 131 | Novel antigens |
| TIKKQSLTLTEIQAH | NBGA6 | 156 | Novel antigens |
| GIAQRKLQSVTAELE | NBGA6 | 186 | Novel antigens |
| RVNELTTINVNLASA | NBGA6 | 226 | Novel antigens |
| TTINVNLASAKSKVE | NBGA6 | 231 | Novel antigens |
| EQERIVKIEAIKKSL | NBGA6 | 286 | Novel antigens |
| LSLIRAKHRTFVTTS | NBGA6 | 431 | Novel antigens |
| PQKFKVVFDTGSSNL | NBGA7 | 36 | Novel antigens |
| VVFDTGSSNLWVPSK | NBGA7 | 41 | Novel antigens |
| WVPSKKCHLTNIACL | NBGA7 | 51 | Novel antigens |
| KCHLTNIACLLHNKY | NBGA7 | 56 | Novel antigens |
| NIACLLHNKYDSTKS | NBGA7 | 61 | Novel antigens |
| NGTSFAIQYGSGSLS | NBGA7 | 81 | Novel antigens |
| SGSLSGFLSTDVLDI | NBGA7 | 91 | Novel antigens |
| GFLSTDVLDIGGLKV | NBGA7 | 96 | Novel antigens |
| DVLDIGGLKVQKQTF | NBGA7 | 101 | Novel antigens |
| EPGLAFVAAKFDGIL | NBGA7 | 121 | Novel antigens |
| FVAAKFDGILGMAYS | NBGA7 | 126 | Novel antigens |

TABLE 5-continued

Bla g Peptides Included in Epitope Screen. (SEQ ID NOs.: 257-1833)

| Sequence | Antigen | Position | Set |
|---|---|---|---|
| FDGILGMAYSTISVD | NBGA7 | 131 | Novel antigens |
| TISVDGVTPVFYNMV | NBGA7 | 141 | Novel antigens |
| GVTPVFYNMVKQGLV | NBGA7 | 146 | Novel antigens |
| FYNMVKQGLVSQPIF | NBGA7 | 151 | Novel antigens |
| KQGLVSQPIFSFYLS | NBGA7 | 156 | Novel antigens |
| SQPIFSFYLSRDPGA | NBGA7 | 161 | Novel antigens |
| SDPNHYKGDFTYLSV | NBGA7 | 186 | Novel antigens |
| YKGDFTYLSVDRKMY | NBGA7 | 191 | Novel antigens |
| TYLSVDRKMYWQFKM | NBGA7 | 196 | Novel antigens |
| DRKMYWQFKMDKIQI | NBGA7 | 201 | Novel antigens |
| WQFKMDKIQIGNGSF | NBGA7 | 206 | Novel antigens |
| IAGPVSEVTALNRQI | NBGA7 | 236 | Novel antigens |
| SEVTALNRQIGGTPI | NBGA7 | 241 | Novel antigens |
| ILGGKKFTLEGKDYI | NBGA7 | 276 | Novel antigens |
| KFTLEGKDYILRVSQ | NBGA7 | 281 | Novel antigens |
| GKDYILRVSQLGHTV | NBGA7 | 286 | Novel antigens |
| LGHTVCLSGFMGIDL | NBGA7 | 296 | Novel antigens |
| CLSGFMGIDLPKGPL | NBGA7 | 301 | Novel antigens |
| WILGDVFIGKFYTEF | NBGA7 | 316 | Novel antigens |
| VFIGKFYTEFDMENN | NBGA7 | 321 | Novel antigens |
| FYTEFDMENNRVGFA | NBGA7 | 326 | Novel antigens |
| AGEKVRIIIDRFMDF | NBGA8 | 16 | Novel antigens |
| RIIIDRFMDFREQEK | NBGA8 | 21 | Novel antigens |
| VPPELVVVFDVRLAV | NBGA8 | 66 | Novel antigens |
| VVVFDVRLAVTVDHA | NBGA8 | 71 | Novel antigens |
| HDEFLNEDIFLKGID | NBGA8 | 176 | Novel antigens |
| NEDIFLKGIDIFCQI | NBGA8 | 181 | Novel antigens |
| LKGIDIFCQIIPAVA | NBGA8 | 186 | Novel antigens |
| IFCQIIPAVANVAPP | NBGA8 | 191 | Novel antigens |
| TLGEAISSSTLRVFA | NBGA9 | 6 | Novel antigens |
| NIREGGFAHFEARLE | NBGA9 | 76 | Novel antigens |
| SSRITTFFNFGYVAL | NBGA9 | 111 | Novel antigens |
| TFFNFGYVALTIKHV | NBGA9 | 116 | Novel antigens |
| GYVALTIKHVTTHDI | NBGA9 | 121 | Novel antigens |

TABLE 6

Non-redundant Bla g Epitopes (SEQ ID NOs.: 1834-1997)

| Sequence | Antigen | Position | Average Magnitude of Response | Response Rate per Subject |
|---|---|---|---|---|
| TIPYYTKKFDEVVKA | Bla g 5 | 126 | 311.6 | 11.4 |
| ISDFRAAIANYHYDA | Bla g 5 | 96 | 216.2 | 18.6 |
| YFVAILDYLNHMAKE | Bla g 5 | 156 | 137.2 | 15.7 |
| VAISRYLGKQFGLSG | Bla g 5 | 66 | 94.9 | 8.6 |
| MIVDTISDFRAAIAN | Bla g 5 | 91 | 91.4 | 7.1 |
| DLVANQPNLKALREK | Bla g 5 | 171 | 91.0 | 7.1 |
| HDDRLGFLTFCPTNL | Bla g 9 | 261 | 83.1 | 7.1 |
| KNRTTIRGRTKFEGN | Bla g 4 | 71 | 81.7 | 2.9 |
| DRKMYWQFKMDKIQI | NBGA7 | 201 | 78.8 | 5.7 |
| ALREKVLGLPAIKAW | Bla g 5 | 181 | 77.1 | 12.9 |
| IRGRTKFEGNKFTID | Bla g 4 | 76 | 75.5 | 5.7 |
| NDIEKRVPFSHDDRL | Bla g 9 | 251 | 72.8 | 15.7 |
| HMAKEDLVANQPNLK | Bla g 5 | 166 | 68.8 | 4.3 |
| VLEKLEAGFAKLAAS | Bla g 9 | 6 | 65.5 | 14.3 |
| NYAIVEGCPAAANGH | Bla g 4 | 111 | 64.6 | 1.4 |
| GIRIYVDVVLNQMSG | Bla g 11 | 108 | 62.5 | 4.3 |
| RWRQIFNMVGFRNAV | Bla g 11 | 388 | 61.7 | 11.4 |
| NIACLLHNKYDSTKS | NBGA7 | 61 | 61.0 | 2.9 |
| NGGYLAAGKLTWADF | Bla g 5 | 141 | 58.5 | 5.7 |
| LNIFTNNLGRINTHV | NBGA1 | 826 | 57.6 | 4.3 |
| KTPVLEIDGKQTHQS | Bla g 5 | 51 | 57.0 | 14.3 |
| PAYFKMNSPSLWKYN | NBGA1 | 941 | 56.1 | 4.3 |
| PKSMLLNIFTNNLGR | NBGA1 | 821 | 52.5 | 7.1 |
| FQINLDFKNHNGFIR | NBGA1 | 1021 | 52.0 | 1.4 |
| SSLFQVANQYTGILY | NBGA1 | 61 | 50.2 | 10.0 |
| VLGLPAIKAWVAKRP | Bla g 5 | 186 | 48.5 | 14.3 |
| QVYRRLVTAVNDIEK | Bla g 9 | 241 | 44.1 | 5.7 |
| RHNSAYKLHFNAFEY | NBGA1 | 226 | 44.0 | 1.4 |
| KLAASDSKSLLRKYL | Bla g 9 | 16 | 43.8 | 7.1 |
| RLFGAEVGWLALHHN | NBGA4 | 781 | 35.5 | 1.4 |
| RVPFSHDDRLGFLTF | Bla g 9 | 256 | 34.2 | 7.1 |
| WVCEHRWRQIFNMVG | Bla g 11 | 383 | 33.9 | 4.3 |
| ATDYENYAIVEGCPA | Bla g 4 | 106 | 32.7 | 1.4 |
| KFTIDYNDKGKAFSA | Bla g 4 | 86 | 32.0 | 11.4 |
| AAIANYHYDADENSK | Bla g 5 | 101 | 26.2 | 11.4 |
| FGSTLLDVIQSGLEN | Bla g 9 | 46 | 26.1 | 8.6 |
| HYQFDSIHKFEFASK | NBGA4 | 1286 | 24.4 | 1.4 |
| TKKFDEVVKANGGYL | Bla g 5 | 131 | 24.3 | 4.3 |

TABLE 6-continued

Non-redundant Bla g Epitopes (SEQ ID NOs.: 1834-1997)

| Sequence | Antigen | Position | Average Magnitude of Response | Response Rate per Subject |
|---|---|---|---|---|
| YLGKQFGLSGKDDWE | Bla g 5 | 71 | 22.6 | 8.6 |
| LNQEAHYQFDSIHKF | NBGA4 | 1281 | 22.6 | 2.9 |
| KCHLTNIACLLHNKY | NBGA7 | 56 | 22.6 | 5.7 |
| GVTPVFYNMVKQGLV | NBGA7 | 146 | 20.8 | 1.4 |
| RCGRSMQGYPFNPCL | Bla g 9 | 126 | 20.4 | 10.0 |
| STSLVKAHSMRNSAS | NBGA1 | 326 | 19.9 | 4.3 |
| LKYFNMGVQKFWAFD | NBGA1 | 881 | 19.8 | 8.6 |
| GASILTYKTSKLYKM | Bla g 11 | 318 | 19.3 | 7.1 |
| NLEIDMIVDTISDFR | Bla g 5 | 86 | 19.1 | 2.9 |
| AKGMMHMIKKGANGS | NBGA3 | 226 | 18.7 | 2.9 |
| PAIKAWVAKRPPTDL | Bla g 5 | 190 | 18.7 | 10.0 |
| VPIMNIYSAFEFDPN | NBGA1 | 1296 | 18.5 | 4.3 |
| KAHSMRNSASMDLSS | NBGA1 | 331 | 16.4 | 4.3 |
| EAGFAKLAASDSKSL | Bla g 9 | 11 | 16.0 | 7.1 |
| DVLQWQTIPYTTIHN | NBGA1 | 1046 | 15.9 | 2.9 |
| KLYKMAVAFMLAYPY | Bla g 11 | 328 | 15.8 | 7.1 |
| AGTWSALNSIQQFIS | NBGA1 | 536 | 15.7 | 7.1 |
| VIYVQIRFSVRRFHP | Bla g 4 | 126 | 15.1 | 2.9 |
| RGNNAIKWLVNFGVG | Bla g 11 | 278 | 15.0 | 5.7 |
| KFEGNKFTIDYNDKG | Bla g 4 | 81 | 14.2 | 4.3 |
| PLKKETIPYYTKKFD | Bla g 5 | 121 | 14.2 | 5.7 |
| QKGYMVSSMTDLWEA | NBGA1 | 841 | 13.9 | 8.6 |
| SPYFVTNTEKMITEF | Hsp60 | 201 | 13.6 | 2.9 |
| RILLRLHRCFQVLGR | NBGA13 | 11 | 13.5 | 1.4 |
| RSEERLATATAKLAE | Bla g 7 | 101 | 13.3 | 1.4 |
| WCNEEDHLRIISMQM | Bla g 9 | 221 | 13.1 | 7.1 |
| RCNNVGIRIYVDVVL | Bla g 11 | 103 | 13.0 | 2.9 |
| LDYLNHMAKEDLVAN | Bla g 5 | 161 | 13.0 | 10.0 |
| AKRFAKWALPLYNKP | NBGA1 | 1476 | 12.2 | 1.4 |
| GEKDFEDYRFQEGDW | Bla g 5 | 26 | 12.0 | 8.6 |
| FYTEFDMENNRVGFA | NBGA7 | 326 | 11.3 | 2.9 |
| CPTNLGTTVRASVRI | Bla g 9 | 271 | 11.2 | 4.3 |
| FRPWWERYQLVSYNL | Bla g 11 | 16 | 10.8 | 4.3 |
| IVINNAGILNDEKWE | NBGA3 | 91 | 10.8 | 4.3 |
| DENSKQKKWDPLKKE | Bla g 5 | 111 | 10.3 | 5.7 |
| LIPVDQIIAIATDYL | Bla g 1.01 | 46 | 9.8 | 1.4 |
| GHSHFVSDVVLSSDG | RACK1 | 61 | 9.6 | 2.9 |

TABLE 6-continued

Non-redundant Bla g Epitopes (SEQ ID NOs.: 1834-1997)

| Sequence | Antigen | Position | Average Magnitude of Response | Response Rate per Subject |
|---|---|---|---|---|
| IHENLIVTSPFRPWW | Bla g 11 | 6 | 9.3 | 2.9 |
| KAIFIKCDVTNIPEF | NBGA3 | 61 | 9.3 | 7.1 |
| MAPSYKLTYCPVKAL | Bla g 5 | 1 | 8.8 | 4.3 |
| LNAIEFINNIHDLLG | Bla g 1 | 376 | 8.8 | 2.9 |
| FLLSYGEKDFEDYRF | Bla g 5 | 21 | 8.5 | 8.6 |
| QDVHKKLREWLSKNV | TPI | 181 | 8.5 | 1.4 |
| HGRTFSSLFQVANQY | NBGA1 | 56 | 8.4 | 4.3 |
| WVPSKKCHLTNIACL | NBGA7 | 51 | 8.4 | 5.7 |
| KNMTYVNTSLVLAFS | NBGA1 | 591 | 8.4 | 2.9 |
| KDDWENLEIDMIVDT | Bla g 5 | 81 | 8.4 | 2.9 |
| QKKWDPLKKETIPYY | Bla g 5 | 116 | 7.7 | 4.3 |
| MNITGSINLMFSQMY | NBGA1 | 976 | 7.6 | 5.7 |
| PVDQIIAIATDYLAN | Bla g 1.01 | 240 | 7.5 | 2.9 |
| QIIAIATDYLANDAE | Bla g 1.01 | 51 | 7.5 | 2.9 |
| MGVQKFWAFDNTTFS | NBGA1 | 886 | 7.3 | 7.1 |
| IQGKFGLDATAVGDE | Enolase | 196 | 6.9 | 1.4 |
| QQFISSEMVEPKEAS | NBGA1 | 546 | 6.8 | 2.9 |
| IDDIIAILPVDDLYA | Bla g 1 | 36 | 6.6 | 2.9 |
| QPNLKALREKVLGLP | Bla g 5 | 176 | 6.5 | 5.7 |
| KVFLKNYLVGNAQFK | NBGA4 | 1471 | 6.4 | 1.4 |
| VVRLQSWQSEMLRMN | NBGA1 | 1456 | 6.4 | 2.9 |
| HTKLSSSSSITLTLP | NBGA1 | 921 | 6.2 | 5.7 |
| KIGEYKNMIAEGIID | Hsp60 | 481 | 6.2 | 1.4 |
| KALQNAESEVAALNR | Bla g 7 | 76 | 6.0 | 1.4 |
| IRFSVRRFHPKLGDK | Bla g 4 | 131 | 5.8 | 2.9 |
| KAIEEDLKHFNLKYE | Bla g 4 | 161 | 5.7 | 2.9 |
| THQFNVAGSVTVDKT | NBGA4 | 1156 | 5.6 | 2.9 |
| IRHAILAAGDLYSRR | NBGA13 | 101 | 5.5 | 1.4 |
| RDMVRRCNNVGIRIY | Bla g 11 | 98 | 5.2 | 5.7 |
| KLGDKEMIQHYTLDQ | Bla g 4 | 141 | 5.0 | 1.4 |
| NASAVIQEFLKTYKK | NBGA1 | 901 | 5.0 | 2.9 |
| VVFDTGSSNLWVPSK | NBGA7 | 41 | 4.7 | 4.3 |
| EVVKANGGYLAAGKL | Bla g 5 | 136 | 4.6 | 5.7 |
| AQIQVVIHLDEQYIY | NBGA5 | 636 | 4.6 | 5.7 |
| ALNSIQQFISSEMVE | NBGA1 | 541 | 4.4 | 4.3 |
| KAAVHLLVAVKASKE | NBGA5 | 511 | 4.4 | 1.4 |
| LVYPTSLGFPLKLVL | NBGA4 | 836 | 4.4 | 2.9 |
| DKKVYRVFESTVTGR | NBGA1 | 171 | 4.4 | 2.9 |

TABLE 6-continued

Non-redundant Bla q Epitopes (SEQ ID NOs.: 1834-1997)

| Sequence | Antigen | Position | Average Magnitude of Response | Response Rate per Subject |
|---|---|---|---|---|
| QTHQSVAISRYLGKQ | Bla g 5 | 61 | 4.3 | 4.3 |
| TGILYKARLSLDRNE | NBGA1 | 71 | 4.3 | 2.9 |
| SINLMFSQMYHAQLA | NBGA1 | 981 | 4.3 | 1.4 |
| STSCNVVASQECVG | Bla g 2 | 56 | 4.2 | 4.3 |
| KQLKVSQIMEAARKL | NBGA1 | 496 | 4.2 | 4.3 |
| PNLKPSMPFGKTPVL | Bla g 5 | 41 | 4.2 | 2.9 |
| NTTFSNASAVIQEFL | NBGA1 | 896 | 4.2 | 5.7 |
| RIKAFLALVECPCNK | NBGA4 | 566 | 4.2 | 1.4 |
| KKLQFTYSESLDLDD | NBGA5 | 51 | 4.2 | 2.9 |
| VEALFLLMKADPSIH | NBGA1 | 716 | 4.2 | 1.4 |
| SVNATVVRLQSWQSE | NBGA1 | 1451 | 4.1 | 2.9 |
| LNTYYSYYYFNYPTF | NBGA2 | 216 | 4.1 | 2.9 |
| VNQHKKAIEEDLKHF | Bla g 4 | 156 | 4.0 | 2.9 |
| VFIGKFYTEFDMENN | NBGA7 | 321 | 4.0 | 2.9 |
| LTVFDSTSCNVVAS | Bla g 2 | 51 | 4.0 | 2.9 |
| LVFLRNAKIELKPNQ | NBGA1 | 1551 | 4.0 | 2.9 |
| DCGVAGFRVDAAKHM | Bla g 11 | 198 | 3.9 | 2.9 |
| SEVTALNRQIGGTPI | NBGA7 | 241 | 3.9 | 2.9 |
| NVIYSQNSFLPRATT | NBGA4 | 661 | 3.8 | 1.4 |
| EIDGKQTHQSVAISR | Bla g 5 | 56 | 3.8 | 4.3 |
| YHYDADENSKQKKWD | Bla g 5 | 106 | 3.7 | 2.9 |
| KVIDLLLSLYLDQNE | NBGA1 | 696 | 3.6 | 7.1 |
| DRRGEMFYYTRQQLY | NBGA2 | 241 | 3.5 | 1.4 |
| LWEINMIKAIISQLQ | NBGA1 | 151 | 3.5 | 2.9 |
| EMIQHYTLDQVNQHK | Bla g 4 | 146 | 3.5 | 2.9 |
| ARYFLERLSNDLPDV | NBGA2 | 256 | 3.5 | 2.9 |
| DVLDIGGLKVQKQTF | NBGA7 | 101 | 3.5 | 2.9 |
| KELVEKYGKGKAIFI | NBGA3 | 51 | 3.4 | 2.9 |
| ERYQLVSYNLNSRSG | Bla g 11 | 21 | 3.4 | 1.4 |
| FSQMYHAQLAFSTAF | NBGA1 | 986 | 3.4 | 2.9 |
| VYEVAIPDRLTLRVE | NBGA3 | 250 | 3.4 | 2.9 |
| DPSIHVLKMVAELTH | NBGA1 | 726 | 3.4 | 1.4 |
| GKDYILRVSQLGHTV | NBGA7 | 286 | 3.4 | 4.3 |
| IAGPVSEVTALNRQI | NBGA7 | 236 | 3.3 | 2.9 |
| SHVHFRFVPSAAVEF | NBGA4 | 876 | 3.3 | 1.4 |
| FRKFSNNFEFSYLLG | NBGA4 | 636 | 3.3 | 1.4 |
| GEPIRFLLSYGEKDF | Bla g 5 | 16 | 3.3 | 2.9 |

TABLE 6-continued

Non-redundant Bla g Epitopes (SEQ ID NOs.: 1834-1997)

| Sequence | Antigen | Position | Average Magnitude of Response | Response Rate per Subject |
|---|---|---|---|---|
| VQKLQKEVDRLEDEL | Bla g 7 | 246 | 3.3 | 1.4 |
| KEFANVVRVVRHTSK | NBGA4 | 346 | 3.3 | 2.9 |
| GQEYTFYVIVTPYAK | NBGA2 | 646 | 3.2 | 2.9 |
| LGHTVCLSGFMGIDL | NBGA7 | 296 | 3.2 | 2.9 |
| CATDTLANEDCFRHE | Bla g 4 | 6 | 3.2 | 2.9 |
| AAVAYLQSDEFETIV | Bla g 1.01 | 260 | 3.2 | 1.4 |
| KTPVLSVNATVVRLQ | NBGA1 | 1446 | 3.2 | 1.4 |
| QTLFLLLLLLAAVSA | NBGA4 | 31 | 3.2 | 1.4 |
| LKNYQLDSELRIKAF | NBGA4 | 556 | 3.2 | 1.4 |
| LRLSEHLDYVKNLTV | NBGA1 | 1336 | 3.1 | 1.4 |
| HHQRLFMVQSLERVV | NBGA1 | 676 | 3.1 | 2.9 |
| LNDYILPAPYEIYPW | NBGA2 | 151 | 3.0 | 2.9 |
| NAIEFLNNIHDLLGI | Bla g 1 | 1 | 3.0 | 1.4 |
| AVLALCATDTLANED | Bla g 4 | 1 | 3.0 | 2.9 |

TABLE 7

Novel CR Proteins (SEQ ID NOs.: 1998-2030)

| Sequence | |
|---|---|
| ALLCCLLVSAASAITPGWLPINSQLDYHVHGRTFSSLFQVANQYTGILYKAR LSLDRNEDQLITGKVTEAQFAPVNTQFSSGWDESVPDEKLHWDVVPMSQQP FQIELNSRGEVRKLRVNKFVELWEINMIKAIISQLQVVVDEDKKVYRVFEST VTGRCEALYEVDHLYPTTYLNPWQWTQQHDTKLRIMKNHQFTNCRHNSA YKLHFNAFEYFHLKQHKPETFLSNSAVSRVIADGDNLKNFTFYSGETIHKIVL NPEIYNKQKGMLVSHINVTVERKGRELTVIDYELRNVGDLSYSTSLVKAHS MRNSASMDLSSSSMSSSSSSSSSSSSSSSSSSSSSSSEEHHSHNQKLSKKRQVP LPRPLFEANFDASSGLTTEQPVTFRPRRQLFQGQDMSEEETEQNPEIIPANLLP TYNLIHNTKQVDVDPVGVAVRLSKDIAADLQGEPRVGEDRHILPRFTILVRL LKQLKVSQIMEAARKLYKLENDHPNYMNWDTWRVYRDAVSQAGTWSAL NSIQQFISSEMVEPKEASHLITVLPAAVSDKNKAYLHFLFEMTKDPVFKNMT YVNTSLVLAFSEVIHQVEMHQVRDLKIKSVYIPYLVQEFDDAVKENNSIKIQ LYTHALGVTGNTHILHYLRPYIIQLKTITHHQRLFMVQSLERVVEHNPRKVI DLLLSLYLDQNEHADIRVEALFLLMKADPSIHVLKMVAELTHTESNNQVLS ASQSAIKSAANVEGDIYSEMRRKAKAVEHLLSTRNMDVSYSKSYLYGYKSK KINYDSLYNLNNIGSEDSIYPKSMLLNIFTNNLGRINTHVQKGYMVSSMTDL WEAFHTIYKKDNGSPTDPKTLVKFVEGNLKYFNMGVQKFWAFDNTTFSNA SAVIQEFLKTYKKPTNFNHTKLSSSSSITLTLPCAMGLPAYFKMNSPSLWKY NGEFSIQTDAKTDVPMSLENFMNITGSINLMFSQMYHAQLAFSTAFDNKEYI SGLDRKVEVHVPVKFQINLDFKNHNGFIRIIPLFTDRDYDVLQWQTIPYTTIH NVPDFETVYMDQLFKLIHVRKTAHFEKKMGENTGIVFKVKYDTDQEFLDTK WFLDEFKVLQLFTGLNYDVPTKDIFYNNLTVYYDHEDTKNHAVSFTVTKEQ SKFYETLNPVVQQNLKLSSGKKQKHRNVKSHRIRREYTEDENPAIPKDKQP NSHPRRQEYLSKSMALTGDATAVVLDMTLKFEGPAESYFTTTVSHATSLVN GSSNYLLFYDQHYYEEKKRNQFCLSWSVYKPQVPIMNIYSAFEFDPNSKVH AIMNIGKECENGGSAVANIDMLRLSEHLDYVKNLTVSKLCDHEMRTKRDH VLPACRNSTERASDLNRVHVDINYNLKQHETFKRRVYKVYDFVRTHLYPH VSEDVIVDNPAQFISANFTLKDNTRAFNVSIKTPVLSVNATVVRLQSWQSEM LRMNPRTSFAKRFAKWALPLYNKPTCVVDSSYINTFDNFTYSAHHIVQNDA FYTILDIPQKFNMEYFKVAFKPTSPVPNMQREVLVFLRNAKIELKPNQGMPE VYVEGKRVDYNHHSTDLNVSQDRIGYVYAFXXXXSSRKP | NBGA1 |
| YHCLSSGINAEYAGSSSTPCSNMTWNALLCCLLVSAASAITPGWLPINSQLD YHVHGRTFSSLFQVANQYTGILYKARLSLDRNEDQLITGKVTEAQFSPVNTQ FSSGWDESVPDEKLHWDVVPMSQQPFQIELNSRGEVRKLRVNKFVELWEIN MIKAIISQLQVVVDEDKKVYRVFESTVTGRCEALYEVDHLYPTTYLNPWQW TQQHDTKLRIMKNHQFTNCRHNSAYKLHFNAFEYFHLKQHKPETFLSNSAV SRVIADGDNLKNFTFYSGETIHKIVLNPEIYNKQKGMLVSHINVTVERKGRE | NBGA1 |

TABLE 7-continued

Novel CR Proteins (SEQ ID NOs.: 1998-2030)

| Sequence | |
|---|---|
| LTVIDYELRNVGDLSYSTSLVKAHSMRNSASMDLSSSSMSSSSSSSSSSSSSSS SSSSSSEEHHSHNQKLSKKRQVPLPRPLFEANFDASSGLTTEQPVTFRPRRQL FQGQDMSEEETEQNPEIIPANLLPTYNLIHNTKQVDVDPVGVAVRLSKDIAA DLQGEPRVGEDRHILPRFTILVRLLKQLKVSQIMEAARKLYKLENDHPNYM NWDTWRVYRDAVSQAGTWSALNSIQQFISSEMVEPKEASHLITVLPAAVSD KNKAYLHFLFEMTKDPVFKNMTYVNTSLVLAFSEVIHQVEMHQVRDLKIKS VYIPYLVQEFDDAVKENNSIKIQLYTHALGVTGNTHILHYLRPYIIQLKTITH HQRLFMVQSLERVVEHNPRKVIDLLLSLYLDQNEHADIRVEALFLLMKADP SIHVLKMVAELTHTESNNQVLSASQSAIKSAANVEGDIYSEMRRKAKAVEH LLSTRNMDVSYSKSYLYGYKSKKINYDSLYNLNYIGSEDSIYPKSMLLNIFT NNLGRINTHVQKGYMVSSMTDLWEAFHTIYKKDNGSPTDPKTLVKFVEGN LKYFNMGVQKFWAFDNTTFSNASAVIQEFLKTYKKPTNFNHTKLSSSSSITL TLPCAMGLPAYFKMNSPSLWKYNGEFSIQTDAKTDVPMSLENFMNITGSINL MFSQMYHAQLAFSTAFDNKEYISGLDRKVEVHVPVKFQINLDFKNHNGFIRI IPLFTDRDYDVLQWQTIPYTTIHNVPDFETVYMDQLFKLIHVRKTAHFEKKM GENTGIVFKVKYDTDQEFLDTKWFLDEFKVLQLFTGLNYDVPTKDIFYNNL TVYYDHEDTKNHAVSFTVTKEQSKFYETLNPVVQQNLKLSSGKKQHRNV KSHRIRREYTEDENPAIPKDQPNSHPRRQEYLSKXMALTGDATAVVLDMT LKFEGPAESYFT | |
| TAHFEKKMGENTGIVFKVKYDTDQEFLDTKWFLDEFKVLQLFTGLNYDVPT KDIFYNNLTVYYDHEDTKNHAVSFTVTKEQSKFYETLNPVVQQNLKLSSGK KQKHRNVKSHRIRREYTEDENPAIPKDQPNSHPRRQEYLSKSMALTGDAT AVVLDMTLKFEGPAESYFTTTVSHATSLVNGSSNYLLFYDQHYYEEKKRNQ FCLSWSVYKPQVPIMNIYSAFEFDPNSKVHAIMNIGKECENGGSAVANIDML RLSEHLDYVKNLTVSKLCDHEMRTKRDHVLPACRNSTERASDLNRVHVDIN YNLKQHETFKRRVYKVYDFVRTHLYPHVSEDVIVDNPAQFISANFTLKDNT RAFNVSIETPVLSVNATSVRLQSWQSEMLRMNPRTSFAKRFAKWALPLYYK PTCVVDSSYINTFDNFTYSAHHIVQNDAFYTILDIPQKFNMEYFKVAFKPTSP VPNMQREVLVFLRNAKIELKPNQGMPEVYVEGKRVDYNHHHSTDLNVSQD RIGYVYALPTKAAHIVFPSYEIEMFYDGSRIMIQASNMYRNFTKGLCGNMD GEFVNDVLTPWGCYAKDMALFVASYADNSNSEVRKIKATQNEQTCVPQFH QPLVSHQMRLSQVIKLADTSSSSESSSSSESHENNSSPSSESQVNKSKRQPNS RPRSSSSSSSSSSSESNESVLAKKIINNQIGPKPTLIPSQSPMTSDDKCMTQQPR HTYYENQFCVSEKPLDTCMPLICHATESYTIDVNFYCVPLGPAANHYMKLV KKGILPDLSRNRNGKRVVLPVEIPIQCEPVLN | NBGA1 |
| ESNNQVLSASQSAIKSAANVEGDIYSEMRRKAKAVEHLLSTRNMDVSYSKS YLYGYKSKKINYDSLYNLNYIGSEDSIYPKSMLLNIFTNNLGRINTHVQKGY MVSSMTDLWEAFHTIYKKDNGSPTDPKTLVKFVEGNLKYFNMGVQKFWAF DNTTFSNASAVIQEFLKTYKKPTNFNHTKLSSSSSITLTLPCAMGLPAYFKMN SPSLWKYNGEFSIQTDAKTDVPMSLENFMNITGSINLMFSQMYHAQLAFSTA FDNKEYISGLDRKVEVHVPVKFQINLDFKNHNGFIRIIPLFTDRDYDVLQWQ TIPYTTIHNVPDFETVYMDQLFKLIHVRKTAHFEKKMGENTGIVFKVKYDTD QEFLDTKWFLDEFKVLQLFTGLNYDVPTKDIFYNNLTVYYDHEDTKNHAVS FTVTKEQSKFYETLNPVVQQNLKLSSGKKQHRNVKSHRIRREYTEDENPAI PKDKQPNSHPRRQEYLSKSMALTGDATAVVLDMTLKFEGPAESYFTTTVSH ATSLVNGSSNYLLFYDQHYYEEKKRNQFCLSWSVYKPQVPIMNIYSAFEFDP NSKVHAIMNIGKECENGGSAVANIDMLRLSEHLDYVKNLTVSKLCDHEMR TKRDHVLPACRNSTERASDLNRVHVDINYNLKQHETFKRRVYKVYDFVRT HLYPHVSEDVIVDNPAQFISANFTLKDNTRAFNVSIKTTCT | NBGA1 |
| YKLENDHPNYMNWDTWRVYRDAVSQAGTWSALNSIQQFISSEMVEPKEAS HLITVLPAAVSDKNKAYLHFLFEMTKDPVFKNMTYVNTSLVLAFSEVIHQV EMHQVRDLKIKSVYIPYLVQEFDDAVKENNSIKIQLYTHALGVTGNTHILHY LRPYIIQLKTITHHQRLFMVQSLERVVEHNPRKVIDLLLSLYLDQNEHADIRV EALFLLMKADPSIHVLKMVAELTHTESNNQVLSASQSAIKSAANVEGDIYSE MRRKAKAVEHLLSTRNMDVSYSKSYLYGYKSKKINYDSLYNLNYIGSEDSI YPKSMLLNIFTNNLGRINTHVQKGYMVSSMTDLWEAFHTIYKKDNGSPTDP KTLVKFVEGNLKYFNIGCPEILGI | NBGA1 |
| EQKINYDSLYNLNYIGSEDSIYPKSMLLNIFTNNLGRINTHVQKGYMVSSMT DLWEAFHTIYKKDNGSPTDPKTLVKFVEGNLKYFNMGVQKFWAFDNTTFS NASAVIQEFLKTYKKPTNFNHTKLSSSSSITLTLPCAMGLPAYFKMNSPSLW KYNGEFSIQTDAKTDVPMSLENFMNITGSINLMFSQMYHAQLAFSTAFDNK EYISGLDRKVEVHVPVKFQINLDFKNHNGFIRIIPLFTDRDYDVLQWQTIPYT TIHNVPDFETVYMDQLFKLIHVRKTAHFEKKMGENTGIVFKVKYDTDQEFL DTKWFLDEFKVLQLFTGLNYDVPTKDIFYNNLTVYYDHEDTKNHSRIFYCD KRTI | NBGA1 |
| MTWNALLCCLLVSAASAITPGWLPINSQLDYHVHGRTFSSLFQVANQYTGIL YKARLSLDRNEDQLITGKVTEAQFSPVNTQFSSGWDESVPDEKLHWDVVP MSQQPFQIELNSRGEVRKLRVNKFVELWEINMIKAIISQLQVVVDEDKKVYR VFESTVTGRCEALYEVDHLYPTTYLNPWQWTQQHDTKLRIMKNHQFTNCR | NBGA1 |

TABLE 7-continued

Novel CR Proteins (SEQ ID NOs.: 1998-2030)

| Sequence | |
|---|---|
| HNSAYKLHFNAFEYFHLKQHKPETFLSNSAVSRVIADGDNLKNFTFYSGETI HKIVLNPEIYNKQKGMLVSHINVTVERKGRELTVIDYELRNVGDLSYSTSLV KDTFDEK | |
| NLQKPTNFNHTKLSSSSSITLTLPCAMGLPAYFKMNSPSLWKYNGEFSIQTD AKTDVPMSLENFMNITGSINLMFSQMYHAQLAFSTAFDNKEYISGLDRKVE VHVPVKFQINLDFKNHNGFIRIIPLFTDRDYDVLQWQTIPYTTIHNVPDFETV YMDQLFKLIHVRKTAHFEKKMGENTGIVFKVKYDTDQEFLDTKWFLDEFK VLQLFTGLNYDVPTKDIFYNNLTVYYDHEDTKNHAVSFTVTKEQSKFYETL NPVVQQNLKLSSGKKQKHRNVKSH | NBGA1 |
| LYIMIMKTPKTIAVSFTVTKEQSKFYETLNPVVQQNLKLSSGKKQKHRNVKS HRIRREYTEDENPAIPKDKQPNSHPRRQEYLSKSMALTGDATAVVLDMTLK FEGPAESYFTTTVSHATSLVNGSSNYLLFYDQHYYEEKKRNQFCLSWSVYK PQVPIMNIYSAFEFDPNSKVHAIMNIGKECENGGSAVANIDMLRLSEHLDYV KNLTVSKLCDHEMRTKRDHVLPACRNSTERASDLNRVHVDINYNLKQHET FKR | NBGA1 |
| QHETFKRRVYKVYDFVRTHLYPHVSEDVIVDNPAQFISANFTLKDNTRAFN VSIKTPVLSVNATVVRLQSWQSEMLRMNPRTSFAKRFAKWALPLYNKPTCV VDSSYINTFDNFTYSAHHIVQNDAFYTILDIPQKFNMEYFKVAFKPTSPVPN MQREVLVFLRNAKXELKPNQGMPEVYVEGKRVDYNHHHSTDLNVSQDRIG YVYALPTKAAHIVFPSYEIEMFYDGSRIMIQASNMYRNFTKGLCGKISVHI | NBGA1 |
| TSLGSINLMFSQMYHAQLAFSTAFDNKEYISGLDRKVEVHVPVKFQINLDFK NHNGFIRIIPLFTDRDYDVCNGRLFHTQPSITYQTLKQSTWINYFKLIHVRKT AHFEKKMGENTGIVFKVKYDTDQEFLDTKWFLDEFKVLQLFTGLNYDVPT KDIFYNNLTVYYDHEDTKNHAVSFTVTKEQSKFYETLNPVVQQNLKLSSGK KQKHRNVKSHRIRREYTE | NBGA1 |
| SSSTPCSNMTWNALLCCLLVSAASAITPGWLPINSQLDYHVHGRTFSSLFQV ANQYTGILYKARLSLDRNEDQLITGKVTEAQFSPVNTQFSSGWDESVPDEKL HWDVVPMSQQPFQIELNSRGEVRKLRVNKFVELWEINMIKAIISQLQVVVD EDKKVYRVFESTVTGRCEALYEVDHLYPTTYLNPWQWTQQHDTKL | NBGA1 |
| YHVHGRTFSSLFQVANQYTGILYKARLSLDRNEDQLITGKVTEAQFSPVNTQ FSSGWDESVPDEKLHWDVVPMSQQPFQIELNSRGEVRKLRVNKFVELWEIN MIKAIISQLQVVVDEDKKVYRVFESTVTGRCEALYEVDHLYPNNIY | NBGA1 |
| WQWTQQHDTKLRIMKNHQFTNCRHNSAYKLHFNAFEYFHLKQHKPETFLS NSAVSRVIADGDNLKNFTFYSGETIHKIVLNPEIYNKQKGMLVSHINVTVER KGRELTVIDYELRNVGRSLLLN | NBGA1 |
| RHNSAYKLHFNAFEYFHLKQHKPETFLSNSAVSRVIADGDNLKNFTFYSGET IHKIVLNPEIYNKQKGMLVSHINVTVERKGRELTVIDYELRNVGDLSYSTSL VKAHSMRNSASIGS | NBGA1 |
| FNMEYFKVAFKPTSPVPNMQREVLVFLRNAKIELKPNQGMPEVYVEGKRV DYNHHHSTDLNVSQDRIGYVYALPTKAAHIVFPSYEIEMFYDGSRIMIQASN MYRNFTKGLLW | NBGA1 |
| TALXLILATAALAVAYPSPGQDYKVLADKTYLTRQRDLLKLLVRIQQPNYY ADQYEIGQSYDIEANINNYKYPYVVKNFVAAYKNGMLARGVPYSPYYTTQ SYETKLLFDLFYYANDYDTFYKTACWARDHINEGQFLYALSSALFQREDLN DYILPAPYEIYPWLFVDSDVIQRAYETRMSDVHLTAPKTYIFPVNYTVHTPE QELNYFYHDVGLNTYYSYYYFNYPTFFNSTEYGVQFDRRGEMFYYTRQQL YARYFLERLSNDLPDVEPLHYDRPFQTEYNPQLRYPNGEDMPVRPYEYSRR SLYYSNGYSHYYGNYYGGNNEYYTGNYYTGDYHPSYYYGYATQYDYYYP EDLQSYERRVRDAIDYGYFFGFQGEKYPLYENYIKGIDYLGDVIEGNGDMV NQRFYGSIYHYYRQLAGKSVDPYNNYGLAPSALQNIYTTLRDPANWQILKR VNYLFQRYKGYLPRYTYDELSFPGIRIDNVDVGKLVTYFEHFDVDLDNVVN VKVAEDGKYIDYRARQTRLNHKPFTYNIEVHSEQATDAYVRVFLGPKYDYL HSEYDLNDRRHYFVEIDRFPYKVQAGKTTITRNSRDSSVVSPDYQSYRTLMR KVYDAYEGKDQFYYDKSEQYCGYPERLLLPKGKLGGQEYTFYVIVTPYAK QDDHDFEPYNYKSFSYCGVGANHRIPDDKPLGYPFDRPVYSHDFVTPNMYF KDVVIYHKKYEEINAATTHQ | NBGA2 |
| YYGGNNNYYNGNYYTGDYKPTYYYGYANQYDYYYPEDLQTYERRVRDAIDYG YFFGFPGGKYPLYDDYIKGIDYLGDAIEGNGDTVNKRLYGSIYHYYRQLAGKN VDPYNDIGLAPSALQNIYTTLRDPANWQILKRVNYLFQRYKGYLPRYTYDELS FPGVRVDNVDVGKLVTYFDYFDIDLDNVVNVKVAEDGKYDYRARXTRLN HKPFTYNVEVYSEQATDVYVRVFLGPKYDYLHREYDLNDRRHYFVEIDRFP YKVQSGKTTITRNSRDSSVVSPDYQSYRTLMRKVYDAYEGKDKFYYDRSE NYCGYPERLLLPKGKLGGQEYTFYVIVTPYVKQDDHDFEPYNYKSFSYCGV GANHRIPDDKPLGYPFDRPVYR | NBGA2 |

TABLE 7-continued

Novel CR Proteins (SEQ ID NOs.: 1998-2030)

| Sequence | |
|---|---|
| YEYDVPRHGEQFYYFYQQIYARYMLERYSNDMPDIKPFTYNKAFKTPYNPQ<br>LRYPNGQEVPARPAYMVPQDFDLYMCLTSXNY | NBGA2 |
| FSNMDIKGKNALVTGAATGIGLEYVKQLLENGAQHVAVCDLDVRKGENAV<br>KELVEKYGKGKAIFIKCDVTNIPEFEDAFKKAYNAFKSLDIVINNAGILNDEK<br>WELQIAINVNGVVRGTLLGLEYMGKDKGGKGGVIVNIASILGLQNMAGCPV<br>YVGTKHAVVGISRSFGMPFHFDRTGVRVLTMCPGVTDTPLISEAHHRQPGE<br>WGEECGRELDSLPKQPPENVAKGMMHMIKKGANGSVWVCEGNKPVYEVA<br>IPDRLTLRVE | NBGA3 |
| CLSSGINAEYAGVLWVCATGMARQVTSKGQQTLFLLLLLLAAVSASQQCKP<br>KCEGKSSAFQTHYEAGNTYVYSFEGGTTTSLPGQQGDGVKLHLKAKAEVSF<br>GDACEAVLKLKDVQVTGPDAQKFTHLNDLESHPVSFSFENGVVGGHICANG<br>HDSEASLNLKRAILAHFQVAPQETARSGKSVVLDVFGLCPTDYSYTERGGTT<br>TITKSRNLNKCHLREHLRQDFASVTYHVESDLQNSPLMESTQEFKHQLQGG<br>VLRVSESHEKYLYRPFANQDAGAKTVVDSKLTYVGHNKKTAPAVSGAEQQ<br>SIIFHPPNVHPGSGSAASVVDALHKAHQAMPEYVGENAAKEFANVVRVVRH<br>TSKNDLLSVYNQVKSGAGFKDKSAGTKMFLDALFRAGTGDAVEVAVELLK<br>SNKITGPHAEFYYLQLAYTRHVTKAALLAAVTLLEQPNPSKLAYLGVGALA<br>GRYCSEHRCDGVAEVDEFLEKLSLLLNGGCKVSNYDEEVKIVATLKALQNA<br>HHLNDAVTSKLQTCLLDDGVPTRIRSAVLDVFQSDACKAKDISLEVLKNYQ<br>LDSELRIKAFLALVECPCNKKANDLKELLDKEPSYQVGSFIVSYLRNLRASA<br>NPSKEKQKAVFGEIRTTKRFPIDFRKFSNNPEFSYLLGGANVGTTVESNVIYS<br>QNSFLPRATTLNLTTEFFGHSVNLLEVELRQENLDLLAEGLFGPKGYFNTHT<br>AAEVVQKGKEHWTDVENTAKQRFNHAIRGKRSVTKEQLELVKSKSVSPYH<br>SETDRELLLELSTRLFGAEVGWLALHHNARDAAKNAFDTTFNLLDKVMKK<br>AKDFDYKLRQHNTFLDTELVYPTSLGFPLKLVLAGSSAVHVELEGKVDVHD<br>LVHNLKNSHVHFRFVPSAAVEFVGAFVVDAYAVEAGLKVAATLHTATGSD<br>ITVKATEDVGVDVTVGLPVQKQDIVTLKTEVLTTVQEKGKPEVNTEISLPGT<br>PRRDYHGCFDQLSPLVGLTFCTTMSFPWDPVASKAAFYPLNGPSKFSLVVE<br>NEDVTSYHFRASLNKADPHKKSLELLLETPGSKTERKLGLILERTYDPYHGV<br>KAQLNSPWKQVSAELAFTDNDKELSLLAKVTNDEQEYYVKLGASVTGDPN<br>HATYHPLLEYKTPERKSSLVSKKGAKGAPEKLTHQFNVAGSVTVDKTANSK<br>KYTFNDVVFTTPQGQYKVDGTVTSEGPTAFSTDLKVYYGENHVVLKSGFK<br>RPSANNFNVHANVQPSQYPDFGVNLIWNHKRDKNNFGNSLAVVHGRDPNS<br>EEARFTLNQEAHYQFDSIHKFEFASKNKVTYPLLGIIGKLDASVQPKTFHLD<br>VEASYEKHKFEAELNANHGQQHTGDYDVKFHAKVLDNSLEFETKRVIVSE<br>GKSKFTTELQVHPGGKYEAVADVTHVFERNNIDFQIDAEAKIHGQPDPYKL<br>DSGLVYNPQLFDAHHKINVGAENYVDVSVNFKRGSGGNPSGNAKVFLKNY<br>LVGNAQFKYTNGEGSATLNVDVPKLGRKLKGTGDLHVKGSQHVATVELY<br>YNAEKKLAFHTDTDLKKDSLDSKNVLSILNYKTEVNVKGTLQGKLEDGQL<br>KGEFGCNSA | NBGA4 |
| PKGKVSRTLKFHDHHYTGPFSVDNVLEFKLPSDKVKHIKMESHLQGELAEK<br>KLQFTYSESLDLDDKTYKLSLESNNELEKGSNKLILVLPNKEPATYVNSWYF<br>NYDDYRSKDVLKGGLTLTRNENAKFSIDVSGKKDYSDLDVHAKLDTPYEK<br>LKHAELSLKNKYVPAPRLEVDTDFSLTVDDKKLAVVNKLTPGPFAGFPNIDF<br>TATHPEGKTRVYVHLTSHKKNEVSGKAELEWPTNGGGKLTSSGKASYESFQ<br>NFRVEADIESAKLNLKKWHVLLANKPQAKGSSSKTLQIQATEAGQPVINGR<br>LEFHVEDKENTYKAGVSGNVQVRSQSQPLKADVFFNKFNPTDNGELGAEV<br>GITIHLGDKSFDALSKHTNKESRASVSVCYQAGQCSVAEAHSVVKVLDFNH<br>LEHDFGAKFDFKACGVNEGFVLTGKNVRQPLSFDHAVELKLLNEKHTTYNF<br>HSYLNEKALGVILTLPQRIIALEGKLGYDKEKGERKVDLGFWLDKKKQPDN<br>KAAVHLLVAVKASKEGTTFHGDAKFSHPALNKEFSVTGKGIALQDDTLLDA<br>SVDLDIFAKKNQKITLVAKLERIPISHGYNVTGHLSAKGKLIDVSLDGGAALS<br>ADGASYISTLAYQDEKHKSKSAQIQVVIHLDEQYIYVKSPTAELIKIERHESN<br>NGKNAKGEVFVLGLEPVEFDETEDFPVSSKAVYYKKILPTRSSPLISCTIC | NBGA5 |
| AGQTREHKEALTRENKKLGDDLHDARNQLADLNRRFHELEIELRRLENERE<br>ELTAAYKEAEAGRKAEEQRAQRLSAELGNFRHEAERRLAEKDEEIESIRKQT<br>AIEIEQLNARVVEAETKLKTEVTRIKKKLQIQITELEMSLDVANKNNIELQKTI<br>KKQSLTLTEIQAHYDEVQRQLQVTLDQYGIAQRKLQSVTAELEEIRGNYEG<br>ALRAKRTAEQQYEETISRVNELTTINVNLASAKSKVEQELSTLAGDYDEVTR<br>ELRAADERYQRVQVELKHTVEILHEEQERIVKIEAIKKSLEIEVKNLSVRLEE<br>VEANAIVGGKRIISKLEARVRDLELELDEEKRRHAETIKILRKKERQVKEVMI<br>QSEEDQKNVSLLQENLDKLVQRVNIYKRQLQEEQGMSQQSVTRVRRFQREL<br>EAAEDRADTAESNLSLIRAKHRTFVTTSTVPGSQVYLVQETHRTTTTSEGI | NBGA6 |
| VHQVRLREYIDGPTPEPLSNYLDAQYYGPISLGTPPQKFKVVFDTGSSNLWV<br>PSKKCHLTNIACLLHNKYDSTKSSTYEQNGTSFAIQYGSGSLSGFLSTDVLDI<br>GGLKVQKQTFAEAMSEPGLAFVAAKFDGILGMAYSTISVDGVTPVFYNMV<br>KQGLVSQPIFSFYLSRDPGAAEGGELILGGSDPNHYKGDFTYLSVDRKMYW<br>QFKMDKIQIGNGSFCADCGEAIADTGTSLIAGPVSEVTALNRQIGGTPIVGGE<br>YMVDCNLIPKLPEIDFILGGKKFTLEGKDYILRVSQLGHTVCLSGFMGIDLPK<br>GPLWILGDVFIGKFYTEFDMENNRVGFAEAV | NBGA7 |

TABLE 7-continued

Novel CR Proteins (SEQ ID NOs.: 1998-2030)

| Sequence | |
|---|---|
| HEGTPGHGSLLLEDTAGEKVRIIIDRFMDFREQEKKKLQSNPNLTVGDVTTV NLTQLKGGVQSNVVPPELVVVFDVRLAVTVDHAEFEAMVKKWCAEAGPG TYVEYEQKEPKVQVTKLDNSNPWWLAFKSACDDMNLELKPAIFPGGTDSR YVRGVGLPALGFSPMNKTPVLLHDHDEFLNEDIFLKGIDIFCQIIPAVANVAP PKK | NBGA8 |
| ALSPTTLGEAISSSTLRVFARTSVTGDLGIPEQQRYIEKVEELEAYQQQQQYK YVQELPESTSPPEFKTPIKDQPNIREGGFAHFEARLEPIGDSTLQVEWLKDGR PVEASSRITTFFNFGYVALTIKHVTTHDIGVYTCRAFNRLGQATTSAQLTVVS KKDIILESQHPGGLEKIQYLEDSSRYDRSTREETTVTQKPRFMG | NBGA9 |
| LFSTNILCDEIKNDEGVLVFTKENFKKGVSDNEFVLVEFYAPWCGHCKSLAP EYIKAAKKLADQESTIKLAKVDATEETELAEEHGVRGYPTLKFFRSGSPIDYS GGRTSDEIVSWLLKKTGPVAKDIASVDDAKSFIDASNVAIIGFFKDSSSEAAK NFLAAANAIDDYPFGITADDAVFGEYSVDGEKVILLQEV | NBGA10 |
| TREGERPMTKDNHLLGKFDLTGIPPAPRGVPQIEVTFEIDANGILQVSAEDKG TGNREKIVITNDQNRLTPDDIERMIKDAEKFADDDKKLKERVEARNELESYA YSLKNQLADKEKLGAKVSDSDKTKMEEAIDEKIKWLEENQDVDTEEYKTQ KKELEDIVQPIIAKLYQGAGGAPPPSNSDDDDELKDEL | NBGA11 |
| QITVTTDDIGQDVSGLELGALLTAMAMVTAKLATVETSCNAQAQEDNHQR PWLNSPSMATKDRTSMTSVSSTDSTLVYKIQPVNNAHGGGDRRCGVAGCS KDLNPGCPNELRVNNGCKSSCYAFNTDQYCCRGQYGTVETCDTSRWPVNS ASYFKSNCPDAYSYAYDDRTSTFTCDDRAYRTHHLLD | NBGA12 |
| SSLEVFFQQQRILLRLHRCFQVLGRWGGDVAFVKHLTALENTDGHNTAAW ASGLKSEDYELLCPDGGRAPVTEYLRCHLAQVPPHMVVTSNDKTENQLNEI RHAILAAGDLYSRRPDLFKLFGDFDGTKDLLFKNSATGLLSV | NBGA13 |
| RHQATQSTQQKKWYXKHCLQMASNTMPYQIASGFSTSQLAMIQNAIDEYH AKTCVTLRPYNSATDRDYVYIKGDESGCWSYVGRIGGRQELNLGTGCFSLG TVEHELLHAWGFYHQQSATERDDYVTIHWENIQSGTENN | NBGA14 |
| YGKIIKRLEAKGFKLVAMKFVWADEELLKKHYADLSSRPFFPGLVKYMSSG PVVPMVWEGLNVVKTGRLMLGATDPKDSNPGTIRGDLCIQVGRNIIHGSDS VESANKEINLWFDSKELIAWKPAVEAWVYED | NBGA15 |
| STRMELQHLQSIEVFPEDEGQYVCXAVNSIGTAKTTCKLKVKPMQDAGRKA KSGDKAPVIVDHLKSDFVKDGEPVILSCRIIGAQKFDVVWLHNNKEIKPSKD FQYTNEANIYKLNIAEIFPEDSGTYTC | NBGA16 |

TABLE 8

Diagnostic Sets (SEQ ID NOs.: 2031-2257)

| Sequence | Protein | Pos | Epitope Set |
|---|---|---|---|
| DCGVAGFRVDAAKHM | Bla g 11 alpha-amylase | 198 | AR |
| LDYERFRGSWIIAAG | Bla g 4 lipocalin | 26 | AR |
| KNRTTIRGRTKFEGN | Bla g 4 lipocalin | 71 | AR |
| IRGRTKFEGNKFTID | Bla g 4 lipocalin | 76 | AR |
| KFEGNKFTIDYNDKG | Bla g 4 lipocalin | 81 | AR |
| ATDYENYAIVEGCPA | Bla g 4 lipocalin | 106 | AR |
| NYAIVEGCPAAANGH | Bla g 4 lipocalin | 111 | AR |
| VIYVQIRFSVRRFHP | Bla g 4 lipocalin | 126 | AR |
| IRFSVRRFHPKLGDK | Bla g 4 lipocalin | 131 | AR |
| KLGDKEMIQHYTLDQ | Bla g 4 lipocalin | 141 | AR |
| KAIEEDLKHFNLKYE | Bla g 4 lipocalin | 161 | AR |
| KTPVLEIDGKQTHQS | Bla g 5 GST | 51 | AR |

TABLE 8-continued

Diagnostic Sets (SEQ ID NOs.: 2031-2257)

| Sequence | Protein | Pos | Epitope Set |
|---|---|---|---|
| DENSKQKKWDPLKKE | Bla g 5 GST | 111 | AR |
| QKKWDPLKKETIPYY | Bla g 5 GST | 116 | AR |
| PLKKETIPYYTKKFD | Bla g 5 GST | 121 | AR |
| TIPYYTKKFDEVVKA | Bla g 5 GST | 126 | AR |
| TKKFDEVVKANGGYL | Bla g 5 GST | 131 | AR |
| YFVAILDYLNHMAKE | Bla g 5 GST | 156 | AR |
| QPNLKALREKVLGLP | Bla g 5 GST | 176 | AR |
| ALREKVLGLPAIKAW | Bla g 5 GST | 181 | AR |
| VLGLPAIKAWVAKRP | Bla g 5 GST | 186 | AR |
| VLEKLEAGFAKLAAS | Bla g 9 arginine kinase | 6 | AR |
| FGSTLLDVIQSGLEN | Bla g 9 arginine kinase | 46 | AR |
| NDIEKRVPFSHDDRL | Bla g 9 arginine kinase | 251 | AR |
| ALNSIQQFISSEMVE | NBGA1 | 541 | AR |
| VEALFLLMKADPSIH | NBGA1 | 716 | AR |
| DPSIHVLKMVAELTH | NBGA1 | 726 | AR |
| PKSMLLNIFTNNLGR | NBGA1 | 821 | AR |
| LNIFTNNLGRINTHV | NBGA1 | 826 | AR |
| KTLVKFVEGNLKYFN | NBGA1 | 871 | AR |
| LKYFNMGVQKFWAFD | NBGA1 | 881 | AR |
| MGVQKFWAFDNTTFS | NBGA1 | 886 | AR |
| NASAVIQEFLKTYKK | NBGA1 | 901 | AR |
| HTKLSSSSSITLTLP | NBGA1 | 921 | AR |
| SVNATVVRLQSWQSE | NBGA1 | 1451 | AR |
| VVRLQSWQSEMLRMN | NBGA1 | 1456 | AR |
| PRHGEQFYYFYQQIY | NBGA2 | 241 | AR |
| DYQSYRTLMRKVYDA | NBGA2 | 601 | AR |
| GQEYTFYVIVTPYAK | NBGA2 | 646 | AR |
| KAIFIKCDVTNIPEF | NBGA3 | 61 | AR |
| IVINNAGILNDEKWE | NBGA3 | 91 | AR |
| KEFANVVRVVRHTSK | NBGA4 | 346 | AR |
| RIKAFLALVECPCNK | NBGA4 | 566 | AR |
| FRKFSNNFEFSYLLG | NBGA4 | 636 | AR |
| NVIYSQNSFLPRATT | NBGA4 | 661 | AR |
| RLFGAEVGWLALHHN | NBGA4 | 781 | AR |
| LVYPTSLGFPLKLVL | NBGA4 | 836 | AR |
| SHVHFRFVPSAAVEF | NBGA4 | 876 | AR |
| KKLQFTYSESLDLDD | NBGA5 | 51 | AR |
| AQIQVVIHLDEQYIY | NBGA5 | 636 | AR |

TABLE 8-continued

Diagnostic Sets (SEQ ID NOs.: 2031-2257)

| Sequence | Protein | Pos | Epitope Set |
|---|---|---|---|
| GVTPVFYNMVKQGLV | NBGA7 | 146 | AR |
| SEVTALNRQIGGTPI | NBGA7 | 241 | AR |
| GKDYILRVSQLGHTV | NBGA7 | 286 | AR |
| NAIEFLNNIHDLLGI | Bla g 1 midgut microvilli protein | 1 | Asthma |
| IDDIIAILPVDDLYA | Bla g 1 midgut microvilli protein | 36 | Asthma |
| LIPVDQIIAIATDYL | Bla g 1 midgut microvilli protein | 46 | Asthma |
| QIIAIATDYLANDAE | Bla g 1 midgut microvilli protein | 51 | Asthma |
| ATDYLANDAEVQAAV | Bla g 1 midgut microvilli protein | 56 | Asthma |
| EYQNLIQKLKDKGVD | Bla g 1 midgut microvilli protein | 86 | Asthma |
| IQKLKDKGVDVDHII | Bla g 1 midgut microvilli protein | 91 | Asthma |
| DKGVDVDHIIELIHQ | Bla g 1 midgut microvilli protein | 96 | Asthma |
| DTRGLPEDLQDFLAL | Bla g 1 midgut microvilli protein | 117 | Asthma |
| LIPTDQVLAIAADYL | Bla g 1 midgut microvilli protein | 131 | Asthma |
| QVLAIAADYLANDAE | Bla g 1 midgut microvilli protein | 136 | Asthma |
| LKALFNEKLETSPDF | Bla g 1 midgut microvilli protein | 152 | Asthma |
| EYLKSDEFETIVVTV | Bla g 1 midgut microvilli protein | 156 | Asthma |
| DEFETIVVTVDSLPE | Bla g 1 midgut microvilli protein | 161 | Asthma |
| IVVTVDSLPEFKNFL | Bla g 1 midgut microvilli protein | 166 | Asthma |
| DDLQDFLALIPVDQI | Bla g 1 midgut microvilli protein | 230 | Asthma |
| PVDQIIAIATDYLAN | Bla g 1 midgut microvilli protein | 240 | Asthma |
| IAIATDYLANDAEVQ | Bla g 1 midgut microvilli protein | 245 | Asthma |
| DYLANDAEVQAAVAY | Bla g 1 midgut microvilli protein | 250 | Asthma |
| DAEVQAAVAYLQSDE | Bla g 1 midgut microvilli protein | 255 | Asthma |
| AAVAYLQSDEFETIV | Bla g 1 midgut microvilli protein | 260 | Asthma |
| VTLDALPELQNFLNF | Bla g 1 midgut microvilli protein | 275 | Asthma |
| LPELQNFLNFLEANG | Bla g 1 midgut microvilli protein | 280 | Asthma |
| HDLLGIPHIPVSGRK | Bla g 1 midgut microvilli protein | 305 | Asthma |
| IPHIPVSGRKYHIRR | Bla g 1 midgut microvilli protein | 310 | Asthma |
| VSGRKYHIRRGVGIT | Bla g 1 midgut microvilli protein | 315 | Asthma |
| PIDQILAIAADYLAN | Bla g 1 midgut microvilli protein | 321 | Asthma |
| DYLANDAEVQAAVEY | Bla g 1 midgut microvilli protein | 331 | Asthma |
| VTVDSLPEFKNFLNF | Bla g 1 midgut microvilli protein | 356 | Asthma |
| LQTNGLNAIEFINNI | Bla g 1 midgut microvilli protein | 371 | Asthma |
| LNAIEFINNIHDLLG | Bla g 1 midgut microvilli protein | 376 | Asthma |
| ATGRKHVRRGVGING | Bla g 1 midgut microvilli protein | 396 | Asthma |
| HVRRGVGINGLIDDV | Bla g 1 midgut microvilli protein | 401 | Asthma |
| VGINGLIDDVIAILP | Bla g 1 midgut microvilli protein | 406 | Asthma |

TABLE 8-continued

Diagnostic Sets (SEQ ID NOs.: 2031-2257)

| Sequence | Protein | Pos | Epitope Set |
|---|---|---|---|
| IAILPVDELYALFQE | Bla g 1 midgut microvilli protein | 416 | Asthma |
| KLESSPEFKALYDAI | Bla g 1 midgut microvilli protein | 431 | Asthma |
| PEFKALYDAIRSPEF | Bla g 1 midgut microvilli protein | 436 | Asthma |
| LYDAIRSPEFQSIVQ | Bla g 1 midgut microvilli protein | 441 | Asthma |
| RSPEFQSIVQTLKAM | Bla g 1 midgut microvilli protein | 446 | Asthma |
| QSIVQTLKAMPEYQD | Bla g 1 midgut microvilli protein | 451 | Asthma |
| TLKAMPEYQDLIQRL | Bla g 1 midgut microvilli protein | 456 | Asthma |
| IHENLIVTSPFRPWW | Bla g 11 alpha-amylase | 6 | Asthma |
| FRPWWERYQLVSYNL | Bla g 11 alpha-amylase | 16 | Asthma |
| ERYQLVSYNLNSRSG | Bla g 11 alpha-amylase | 21 | Asthma |
| RCNNVGIRIYVDVVL | Bla g 11 alpha-amylase | 103 | Asthma |
| GIRIYVDVVLNQMSG | Bla g 11 alpha-amylase | 108 | Asthma |
| RGNNAIKWLVNFGVG | Bla g 11 alpha-amylase | 278 | Asthma |
| GASILTYKTSKLYKM | Bla g 11 alpha-amylase | 318 | Asthma |
| KLYKMAVAFMLAYPY | Bla g 11 alpha-amylase | 328 | Asthma |
| WVCEHRWRQIFNMVG | Bla g 11 alpha-amylase | 383 | Asthma |
| RWRQIFNMVGFRNAV | Bla g 11 alpha-amylase | 388 | Asthma |
| LTVFDSTSCNVVAS | Bla g 2 inactive aspartic protease | 51 | Asthma |
| STSCNVVVASQECVG | Bla g 2 inactive aspartic protease | 56 | Asthma |
| GRGIEDSLTISNLTT | Bla g 2 inactive aspartic protease | 106 | Asthma |
| SQQDIVLADELSQEV | Bla g 2 inactive aspartic protease | 121 | Asthma |
| AVLALCATDTLANED | Bla g 4 lipocalin | 1 | Asthma |
| CATDTLANEDCFRHE | Bla g 4 lipocalin | 6 | Asthma |
| LANEDCFRHESLVPN | Bla g 4 lipocalin | 11 | Asthma |
| PYSVLATDYENYAIV | Bla g 4 lipocalin | 101 | Asthma |
| VNQHKKAIEEDLKHF | Bla g 4 lipocalin | 156 | Asthma |
| KHFNLKYEDLHSTCH | Bla g 4 lipocalin | 168 | Asthma |
| MAPSYKLTYCPVKAL | Bla g 5 GST | 1 | Asthma |
| KLTYCPVKALGEPIR | Bla g 5 GST | 6 | Asthma |
| FLLSYGEKDFEDYRF | Bla g 5 GST | 21 | Asthma |
| GEKDFEDYRFQEGDW | Bla g 5 GST | 26 | Asthma |
| PNLKPSMPFGKTPVL | Bla g 5 GST | 41 | Asthma |
| QTHQSVAISRYLGKQ | Bla g 5 GST | 61 | Asthma |
| VAISRYLGKQFGLSG | Bla g 5 GST | 66 | Asthma |
| YLGKQFGLSGKDDWE | Bla g 5 GST | 71 | Asthma |
| KDDWENLEIDMIVDT | Bla g 5 GST | 81 | Asthma |
| NLEIDMIVDTISDFR | Bla g 5 GST | 86 | Asthma |
| MIVDTISDFRAAIAN | Bla g 5 GST | 91 | Asthma |

TABLE 8-continued

Diagnostic Sets (SEQ ID NOs.: 2031-2257)

| Sequence | Protein | Pos | Epitope Set |
|---|---|---|---|
| ISDFRAAIANYHYDA | Bla g 5 GST | 96 | Asthma |
| AAIANYHYDADENSK | Bla g 5 GST | 101 | Asthma |
| YHYDADENSKQKKWD | Bla g 5 GST | 106 | Asthma |
| EVVKANGGYLAAGKL | Bla g 5 GST | 136 | Asthma |
| NGGYLAAGKLTWADF | Bla g 5 GST | 141 | Asthma |
| AAGKLTWADFYFVAI | Bla g 5 GST | 146 | Asthma |
| HMAKEDLVANQPNLK | Bla g 5 GST | 166 | Asthma |
| DLVANQPNLKALREK | Bla g 5 GST | 171 | Asthma |
| AAKFIIEEDSEAMEK | Bla g 6 troponin C | 76 | Asthma |
| IEEDSEAMEKELREA | Bla g 6 troponin C | 81 | Asthma |
| EAMEKELREAFRLYD | Bla g 6 troponin C | 86 | Asthma |
| ELREAFRLYDKEGNG | Bla g 6 troponin C | 91 | Asthma |
| FRLYDKEGNGYIPTS | Bla g 6 troponin C | 96 | Asthma |
| KEGNGYIPTSCLREI | Bla g 6 troponin C | 101 | Asthma |
| YIPTSCLREILRELD | Bla g 6 troponin C | 106 | Asthma |
| DELDMMIEEIDADGS | Bla g 6 troponin C | 126 | Asthma |
| KALQNAESEVAALNR | Bla g 7 tropomysin | 76 | Asthma |
| RSEERLATATAKLAE | Bla g 7 tropomysin | 101 | Asthma |
| VQKLQKEVDRLEDEL | Bla g 7 tropomysin | 246 | Asthma |
| KEVDRLEDELVHEKE | Bla g 7 tropomysin | 251 | Asthma |
| EAGFAKLAASDSKSL | Bla g 9 arginine kinase | 11 | Asthma |
| KLAASDSKSLLRKYL | Bla g 9 arginine kinase | 16 | Asthma |
| RCGRSMQGYPFNPCL | Bla g 9 arginine kinase | 126 | Asthma |
| LIDDHFLFKEGDRFL | Bla g 9 arginine kinase | 181 | Asthma |
| FLFKEGDRFLQHANA | Bla g 9 arginine kinase | 186 | Asthma |
| WCNEEDHLRIISMQM | Bla g 9 arginine kinase | 221 | Asthma |
| QVYRRLVTAVNDIEK | Bla g 9 arginine kinase | 241 | Asthma |
| RVPFSHDDRLGFLTF | Bla g 9 arginine kinase | 256 | Asthma |
| HDDRLGFLTFCPTNL | Bla g 9 arginine kinase | 261 | Asthma |
| CPTNLGTTVRASVRI | Bla g 9 arginine kinase | 271 | Asthma |
| SPYFVTNTEKMITEF | GroEL-like chaperonin | 201 | Asthma |
| KIGEYKNMIAEGIID | GroEL-like chaperonin | 481 | Asthma |
| RHNSAYKLHFNAFEY | NBGA1 | 226 | Asthma |
| STSLVKAHSMRNSAS | NBGA1 | 326 | Asthma |
| AVRLSKDIAADLQGE | NBGA1 | 461 | Asthma |
| LVRLLKQLKVSQIME | NBGA1 | 491 | Asthma |
| KQLKVSQIMEAARKL | NBGA1 | 496 | Asthma |

TABLE 8-continued

Diagnostic Sets (SEQ ID NOs.: 2031-2257)

| Sequence | Protein | Pos | Epitope Set |
|---|---|---|---|
| QQFISSEMVEPKEAS | NBGA1 | 546 | Asthma |
| KNMTYVNTSLVLAFS | NBGA1 | 591 | Asthma |
| QKGYMVSSMTDLWEA | NBGA1 | 841 | Asthma |
| NTTFSNASAVIQEFL | NBGA1 | 896 | Asthma |
| PAYFKMNSPSLWKYN | NBGA1 | 941 | Asthma |
| MNITGSINLMFSQMY | NBGA1 | 976 | Asthma |
| SINLMFSQMYHAQLA | NBGA1 | 981 | Asthma |
| FSQMYHAQLAFSTAF | NBGA1 | 986 | Asthma |
| FQINLDFKNHNGFIR | NBGA1 | 1021 | Asthma |
| DVLQWQTIPYTTIHN | NBGA1 | 1046 | Asthma |
| VPIMNIYSAFEFDPN | NBGA1 | 1296 | Asthma |
| LRLSEHLDYVKNLTV | NBGA1 | 1336 | Asthma |
| AKRFAKWALPLYNKP | NBGA1 | 1476 | Asthma |
| HIVFPSYEIEMFYDG | NBGA1 | 1606 | Asthma |
| SYEIEMFYDGSRIMI | NBGA1 | 1611 | Asthma |
| RILLRLHRCFQVLGR | NBGA13 | 11 | Asthma |
| IRHAILAAGDLYSRR | NBGA13 | 101 | Asthma |
| QSYETKLLFDLFYYA | NBGA2 | 101 | Asthma |
| KLLFDLFYYANDYDT | NBGA2 | 106 | Asthma |
| HINEGQFLYALSSAL | NBGA2 | 131 | Asthma |
| QFLYALSSALFQRED | NBGA2 | 136 | Asthma |
| LNDYILPAPYEIYPW | NBGA2 | 151 | Asthma |
| EIYPWLFVDSDVIQR | NBGA2 | 161 | Asthma |
| LNTYYSYYYFNYPTF | NBGA2 | 216 | Asthma |
| SYYYFNYPTFFNSTE | NBGA2 | 221 | Asthma |
| DRRGEMFYYTRQQLY | NBGA2 | 241 | Asthma |
| MFYYTRQQLYARYFL | NBGA2 | 246 | Asthma |
| RQQLYARYFLERLSN | NBGA2 | 251 | Asthma |
| ARYFLERLSNDLPDV | NBGA2 | 256 | Asthma |
| QATDAYVRVFLGPKY | NBGA2 | 541 | Asthma |
| KELVEKYGKGKAIFI | NBGA3 | 51 | Asthma |
| EDAFKKAYNAFKSLD | NBGA3 | 76 | Asthma |
| AKGMMHMIKKGANGS | NBGA3 | 226 | Asthma |
| VYEVAIPDRLTLRVE | NBGA3 | 250 | Asthma |
| QTLFLLLLLLAAVSA | NBGA4 | 31 | Asthma |
| SLLLNGGCKVSNYDE | NBGA4 | 481 | Asthma |
| EVKIVATLKALQNAH | NBGA4 | 496 | Asthma |
| ISLEVLKNYQLDSEL | NBGA4 | 551 | Asthma |

TABLE 8-continued

Diagnostic Sets (SEQ ID NOs.: 2031-2257)

| Sequence | Protein | Pos | Epitope Set |
|---|---|---|---|
| LKNYQLDSELRIKAF | NBGA4 | 556 | Asthma |
| QVGSFIVSYLRNLRA | NBGA4 | 596 | Asthma |
| THQFNVAGSVTVDKT | NBGA4 | 1156 | Asthma |
| LNQEAHYQFDSIHKF | NBGA4 | 1281 | Asthma |
| HYQFDSIHKFEFASK | NBGA4 | 1286 | Asthma |
| KAAVHLLVAVKASKE | NBGA5 | 511 | Asthma |
| WVPSKKCHLTNIACL | NBGA7 | 51 | Asthma |
| KCHLTNIACLLHNKY | NBGA7 | 56 | Asthma |
| DVLDIGGLKVQKQTF | NBGA7 | 101 | Asthma |
| DRKMYWQFKMDKIQI | NBGA7 | 201 | Asthma |
| GHSHFVSDVVLSSDG | RACK1 | 61 | Asthma |
| HGRTFSSLFQVANQY | NBGA1 | 56 | CNT |
| LLMKADPSIHVLKMV | NBGA1 | 721 | CNT |
| QVLSASQSAIKSAAN | NBGA1 | 746 | CNT |
| SKVHAIMNIGKECEN | NBGA1 | 1311 | CNT |
| FKRRVYKVYDFVRTH | NBGA1 | 1396 | CNT |
| EYFKVAFKPTSPVPN | NBGA1 | 1531 | CNT |
| TFEIDANGILQVSAE | NBGA11 | 36 | CNT |
| NNFEFSYLLGGANVG | NBGA4 | 641 | CNT |
| KLDSGLVYNPQLFDA | NBGA4 | 1426 | CNT |
| DLHVKGSQHVATVEL | NBGA4 | 1511 | CNT |
| LDSKNVLSILNYKTE | NBGA4 | 1546 | CNT |
| VLSILNYKTEVNVKG | NBGA4 | 1551 | CNT |
| QTLFAGYFDNTIRVW | RACK1 | 296 | CNT |
| VVFQQTKAIADKIKD | TPI | 141 | CNT |
| WSKVVIAYEPVWAIG | TPI | 156 | CNT |
| YWTIDFDIAVARVST | trypsin | 111 | CNT |

Example 13

Embodiments

A1. A protein or peptide having an amino acid sequence comprising, consisting of, or consisting essentially of an amino acid sequence set forth in Tables 5 to 8, or a subsequence, portion, homologue, variant or derivative thereof, for use in modulating immune activity of a cell against a Cockroach allergen.

A2. The protein or peptide of embodiment A1, wherein modulating the immune activity of a cell comprises inducing immunological tolerance to the Cockroach allergen.

A3. A protein or peptide having an amino acid sequence comprising, consisting of, or consisting essentially of an amino acid sequence set forth in Tables 5 to 8, or a subsequence, portion, homologue, variant or derivative thereof, for use in modulating an immune response against a Cockroach allergen in a subject.

A4. The protein or peptide of embodiment of A3, wherein the modulating of the immune response in the subject comprises administering to the subject an amount of the protein or peptide sufficient to modulate the immune response against the Cockroach allergen in the subject.

A5. A protein or peptide having an amino acid sequence comprising, consisting of, or consisting essentially of an amino acid sequence set forth in Tables 5 to 8, or a subsequence, portion, homologue, variant or derivative thereof, for use in preventing an allergic response, allergic disorder or allergic disease in a subject, or for use in preventing one or more physiological conditions, disorders, illnesses, diseases, symptoms or complications in a subject, wherein the allergic response, allergic disorder, allergic disease, or one or more physiological conditions, disorders, illnesses, diseases, symptoms or complications is caused by or associated with a Cockroach allergen.

A6. A protein or peptide having an amino acid sequence comprising, consisting of, or consisting essentially of an amino acid sequence set forth in Tables 5 to 8, or a subsequence, portion, homologue, variant or derivative thereof, for use in treating a subject for an allergic response, allergic disorder or allergic disease, or one or more physiological conditions, disorders, illnesses, diseases, symptoms or complications caused by or associated with a Cockroach allergen.

A7. The protein or peptide of embodiment A6, wherein treating comprises inducing in the subject immunological tolerance to the allergen.

A8. The protein or peptide of embodiment A6 or A7, comprising the use of two or more proteins, peptides, subsequences, portions, homologues, variants or derivatives thereof set forth in Tables 5-8.

A9. The protein or peptide of any one of embodiment A6 or A7, comprising the use of one protein, peptide, subsequence, portion, homologue, variant or derivative thereof as set forth in Tables 5-8.

A10. The protein or peptide of any one of embodiments A6 to A9, comprising the use of a peptide comprising an amino acid sequence of any of (SEQ ID NOs.: 1-23): TIPYYTKKFDEVVKA (SEQ ID NO: 1), ISDFRAAIANYHYDA (SEQ ID NO: 2), YFVAILDYLNHMAKE (SEQ ID NO: 3), VAISRYLGKQFGLSG (SEQ ID NO: 4), MIVDTISDFRAAIAN (SEQ ID NO: 5), DLVANQPNLKALREK (SEQ ID NO: 6), HDDRLGFLTFCPTNL (SEQ ID NO: 7), KNRTTIRGRTKFEGN (SEQ ID NO: 8), DRKMYWQFKMDKIQI (SEQ ID NO: 9), ALREKVLGLPAIKAW (SEQ ID NO: 10), IRGRTKFEGNKFTID (SEQ ID NO: 11), NDIEKRVPFSHDDRL (SEQ ID NO: 12), HMAKEDLVANQPNLK (SEQ ID NO: 13), VLEKLEAGFAKLAAS (SEQ ID NO: 14), NYAIVEGCPAAANGH (SEQ ID NO: 15), GIRIYVDVVLNQMSG (SEQ ID NO: 16), RWRQIFNMVGFRNAV (SEQ ID NO: 17), NIACLLHNKYDSTKS (SEQ ID NO: 18), NGGYLAAGKLTWADF (SEQ ID NO: 19), LNIFTNNLGRINTHV (SEQ ID NO: 20), KTPVLEIDGKQTHQS (SEQ ID NO: 21), PAYFKMNSPSLWKYN (SEQ ID NO: 22), PKSMLLNIFTNNLGR (SEQ ID NO: 23), or a subsequence, portion, homologue, variant or derivative thereof, or a combination thereof.

A11. The protein or peptide of any one of embodiments A6 to A9, comprising the use of a peptide comprising an amino acid sequence of any of (SEQ ID NOs.: 1-23): TIPYYTKKFDEVVKA (SEQ ID NO: 1), ISDFRAAIANYHYDA (SEQ ID NO: 2), YFVAILDYLNHMAKE (SEQ ID NO: 3), VAISRYLGKQFGLSG (SEQ ID NO: 4), MIVDTISDFRAAIAN (SEQ ID NO: 5), DLVANQPNLKALREK (SEQ ID NO: 6), HDDRLGFLTFCPTNL (SEQ ID NO: 7), KNRTTIRGRTKFEGN (SEQ ID NO: 8), DRKMYWQFKMDKIQI (SEQ ID NO: 9), ALREKVLGLPAIKAW (SEQ ID NO: 10), IRGRTKFEGNKFTID (SEQ ID NO: 11), NDIEKRVPFSHDDRL (SEQ ID NO: 12), HMAKEDLVANQPNLK (SEQ ID NO: 13), VLEKLEAGFAKLAAS (SEQ ID NO: 14), NYAIVEGCPAAANGH (SEQ ID NO: 15), GIRIYVDVVLNQMSG (SEQ ID NO: 16), RWRQIFNMVGFRNAV (SEQ ID NO: 17), NIACLLHNKYDSTKS (SEQ ID NO: 18), NGGYLAAGKLTWADF (SEQ ID NO: 19), LNIFTNNLGRINTHV (SEQ ID NO: 20), KTPVLEIDGKQTHQS (SEQ ID NO: 21), PAYFKMNSPSLWKYN (SEQ ID NO: 22), PKSMLLNIFTNNLGR (SEQ ID NO: 23), or a combination thereof.

A12. The protein or peptide of any one of embodiments A6 to A9, comprising the use of a peptide comprising an amino acid sequence of any of (SEQ ID NOs.: 24-45): FETIVVTVDSLPEFK (SEQ ID NO: 24), LIDDVLAILPLDDLK (SEQ ID NO: 25), FAVATITHAAELQRV (SEQ ID NO: 26), PLYKLVHVFINTQYA (SEQ ID NO: 27), GNQNFLTVFDSTSCN (SEQ ID NO: 28), ISSQYYIQQNGNLC (SEQ ID NO: 29), HFFIGDFFVDHYYSE (SEQ ID NO: 30), GEPIRFLLSYGEKDF (SEQ ID NO: 31), FLLSYGEKDFEDYRF (SEQ ID NO: 32), SMPFGKTPVLEIDGK (SEQ ID NO: 33), VAISRYLGKQFGLSG (SEQ ID NO: 34), ISDFRAAIANYHYDA (SEQ ID NO: 35), YFVAILDYLNHMAKE (SEQ ID NO: 36), HMAKEDLVANQPNLK (SEQ ID NO: 37), DLVANQPNLKALREK (SEQ ID NO: 38), ALREKVLGLPAIKAW (SEQ ID NO: 39), VLGLPAIKAWVAKRP (SEQ ID NO: 40), EQISVLRKAFDAFDR (SEQ ID NO: 41), LRKAFDAFDREKSGS (SEQ ID NO: 42), EFVTLAAKFIIEEDS (SEQ ID NO: 43), EAMEKELREAFRLYD (SEQ ID NO: 44), or SGTVDFDEFMEMMTG (SEQ ID NO: 45).

A13. A protein or peptide having an amino acid sequence comprising, consisting of, or consisting essentially of an amino acid sequence set forth in Tables 5 to 8, or a subsequence, portion, homologue, variant or derivative thereof, for use in diagnosing and treating a Cockroach allergy in a subject.

A14. The protein or peptide of embodiment A13, wherein the diagnosing comprises contacting a cell from the subject with the protein or peptide, determining if the protein or peptide modulates immune activity from the contacted cell, wherein a determination that the protein or peptide modulates immune activity from the contacted cell indicates that the subject has a Cockroach allergy.

A15. A protein or peptide having an amino acid sequence comprising, consisting of, or consisting essentially of an amino acid sequence set forth in Tables 5 to 8, or a subsequence, portion, homologue, variant or derivative thereof, for use in detecting an allergic response to a Cockroach protein or peptide in a subject.

A16. The protein or peptide of embodiment A15, comprising:
i. contacting a cell from the subject with the protein or peptide; and
ii. determining if the protein or peptide modulates immune activity from the contacted cell; wherein a determination that the protein or peptide modulates immune activity from the contacted cell thereby detects an allergic response to the Cockroach allergen in the subject.

A17. The protein or peptide of any one of embodiments A1 to A16, wherein the protein or peptide comprises, consists of, or consists essentially of an amino acid sequence set forth in Table 8.

A16. The protein or peptide of any one of embodiments A1 to A17, wherein the subject is a human.

REFERENCES

1. Kanchongkittiphon W, Mendell M J, Gaffin J M, Wang G, Phipatanakul W. Indoor Environmental Exposures and Exacerbation of Asthma: An Update to the 2000 Review by the Institute of Medicine. Environ Health Perspect 2014;
2. Camelo-Nunes I C, Solé D. Cockroach allergy: risk factor for asthma severity. J Pediatr (Rio J) 2006; 82:398-9—authorreply 399-400.
3. Yi M-H, Jeong K Y, Kim C-R, Yong T-S. IgE-binding reactivity of peptide fragments of Bla g 1.02, a major German cockroach allergen. Asian Pac J Allergy Immunol 2009; 27:121-9.
4. Jeong K Y, Lee J, Lee I-Y, Ree H-I, Hong C-S, Yong T-S. Allergenicity of recombinant Bla g 7, German cockroach tropomyosin. Allergy 2003; 58:1059-63.
5. Pomes A, Vailes L D, Helm R M, Chapman M D. IgE reactivity of tandem repeats derived from cockroach allergen, Bla g 1. Eur J Biochem 2002; 269:3086-92.
6. Shin K H, Jeong K Y, Hong C-S, Yong T-S. IgE binding reactivity of peptide fragments of Bla g 4, a major German cockroach allergen. Korean J Parasitol 2009; 47:31-6.
7. Jeong K-J, Jeong K Y, Kim C-R, Yong T-S. IgE-binding epitope analysis of Bla g 5, the German cockroach allergen. Protein Pept Lett 2010; 17:573-7.
8. Khurana T, Collison M, Chew F T, Slater J E. Bla g 3: a novel allergen of German cockroach identified using cockroach-specific avian single-chain variable fragment antibody. Ann Allergy Asthma Immunol 2014; 112:140-1.
9. Un S, Jeong K Y, Yi M-H, Kim C-R, Yong T-S. IgE binding epitopes of Bla g 6 from German cockroach. Protein Pept Lett 2010; 17:1170-6.
10. Lee H, Jeong K Y, Shin K H, Yi M-H, Gantulaga D, Hong C-S, et al. Reactivity of German cockroach allergen, Bla g 2, peptide fragments to IgE antibodies in patients' sera. Korean J Parasitol 2008; 46:243-6.
11. Jeong K Y, Kim C-R, Park J, Han I-S, Park J-W, Yong T-S. Identification of novel allergenic components from German cockroach fecal extract by a proteomic approach. Int Arch Allergy Immunol 2013; 161:315-24.
12. Arruda L K, Barbosa M C R, Santos A B R, Moreno A S, Chapman M D, Pomes A. Recombinant allergens for diagnosis of cockroach allergy. Curr Allergy Asthma Rep 2014; 14:428.
13. Arruda L K, Vailes L D, Ferriani V P, Santos A B, Pomés A, Chapman M D. Cockroach allergens and asthma. Journal of Allergy and Clinical Immunology 2001; 107: 419-28.
14. Chen H, Yang H-W, Wei J-F, Tao A-L. In silico prediction of the T-cell and IgE-binding epitopes of Per a 6 and Bla g 6 allergens in cockroaches. Mol Med Rep 2014; 10:2130-6.
15. Oseroff C, Sidney J, Tripple V, Grey H, Wood R, Broide D H, et al. Analysis of T cell responses to the major allergens from German cockroach: epitope specificity and relationship to IgE production. The Journal of Immunology 2012; 189:679-88.
16. Schulten V, Greenbaum J A, Hauser M, McKinney D M, Sidney J, Kolla R, et al. Previously undescribed grass pollen antigens are the major inducers of T helper 2 cytokine-producing T cells in allergic individuals. Proc Natl Acad Sci USA 2013; 110:3459-64.
17. Chuang J-G, Su S-N, Chiang B-L, Lee H-J, Chow L-P. Proteome mining for novel IgE-binding proteins from the German cockroach (*Blattella germanica*) and allergen profiling of patients. Proteomics [Internet] 2010; 10:3854-67. Available from: hap://onlinelibrary.wiley.com/doi/10.1002/pmic.201000348/abstract;jsessionid=9718A2AA03D40591B9C468E16B09A498.f02t04
18. Oseroff C, Sidney J, Kotturi M F, Kolla R, Alam R, Broide D H, et al. Molecular Determinants of T Cell Epitope Recognition to the Common Timothy Grass Allergen. The Journal of Immunology 2010; 185:943-55.
19. Wambre E, Bonvalet M, Bodo V B, Maillère B, Leclert G, Moussu H, et al. Distinct characteristics of seasonal (Bet v 1) vs. perennial (Der p 1/Der p 2) allergen-specific CD4(+) T cell responses. Clin Exp Allergy 2011; 41:192-203.
20. Lindestam Arlehamn C S, Sidney J, Henderson R, Greenbaum J A, James E A, Moutaftsi M, et al. Dissecting Mechanisms of Immunodominance to the Common Tuberculosis Antigens ESAT-6, CFP10, Rv2031c (hspX), Rv2654c (TB7.7), and Rv1038c (EsxJ). The Journal of Immunology 2012; 188:5020-31.
21. Scadding G. Cytokine profiles in allergic rhinitis. Curr Allergy Asthma Rep 2014; 14:435.
22. Maes T, Joos G F, Brusselle G G. Targeting interleukin-4 in asthma: lost in translation? Am J Respir Cell Mol Biol 2012; 47:261-70.
23. Cosmi L, Liotta F, Maggi E, Romagnani S, Annunziato F. Th17 cells: new players in asthma pathogenesis. Allergy 2011; 66:989-98.
24. Ota K, Kawaguchi M, Matsukura S, Kurokawa M, Kokubu F, Fujita J, et al. Review Article. Journal of Immunology Research 2014; 1-8.
25. Zhang H, Kong H, Zeng X, Guo L, Sun X, He S. Subsets of regulatory T cells and their roles in allergy. Journal of Translational Medicine 2014; 12:125.
26. Schulten V, Oseroff C, Alam R, Broide D, Vijayanand P, Peters B, et al. The identification of potentially pathogenic and therapeutic epitopes from common human allergens. Ann Allergy Asthma Immunol 2013; 110:7-10.
27. Crotty S. Follicular helper CD4 T cells (TFH). Annu Rev Immunol 2011; 29:621-63.
28. Bassirpour G, Zoratti E. Cockroach allergy and allergen-specific immunotherapy in asthma. Current Opinion in Allergy and Clinical Immunology 2014; 1.
29. Pomés A, Arruda L K. Investigating cockroach allergens: aiming to improve diagnosis and treatment of cockroach allergic patients. Methods 2014; 66:75-85.
30. Mukherjee S, Berger M F, Jona G, Wang X S, Muzzey D, Snyder M, et al. Rapid analysis of the DNA-binding specificities of transcription factors with DNA microarrays. Nat Genet 2004; 36:1331-9.
31. Kumar S, Blaxter M L. Comparing de novo assemblers for 454 transcriptome data. BMC Genomics 2010; 11:571.
32. The use of standardized allergen extracts. American Academy of Allergy, Asthma and Immunology (AAAAI). J. Allergy Clin. Immunol. 1997; 99:583-6.
33. Lopes M I L, Miranda P J, Sarinho E. Use of the skin prick test and specific immunoglobulin E for the diagnosis of cockroach allergy. J Pediatr (Rio J) 2006; 82:204-9.
34. Schulten V, Tripple V, Sidney J, Greenbaum J, Frazier A, Alam R, et al. Association between specific timothy grass antigens and changes in $T_H1$- and $T_H2$-cell responses following specific immunotherapy. J Allergy Clin Immunol 2014; 134:1076-83.

SEQUENCE LISTING (2257 sequences)

SEQ ID NO: 1 - protein, 15 aa, Blattella germanica
TIPYYTKKFDEVVKA

SEQ ID NO: 2 - protein, 15 aa, Blattella germanica
ISDFRAAIANYHYDA

SEQ ID NO: 3 - protein, 15 aa, Blattella germanica
YFVAILDYLNHMAKE

SEQ ID NO: 4 - protein, 15 aa, Blattella germanica
VAISRYLGKQFGLSG

SEQ ID NO: 5 - protein, 15 aa, Blattella germanica
MIVDTISDFRAAIAN

SEQ ID NO: 6 - protein, 15 aa, Blattella germanica
DLVANQPNLKALREK

SEQ ID NO: 7 - protein, 15 aa, Blattella germanica
HDDRLGFLTFCPTNL

SEQ ID NO: 8 - protein, 15 aa, Blattella germanica
KNRTTIRGRTKFEGN

SEQ ID NO: 9 - protein, 15 aa, Blattella germanica
DRKMYWQFKMDKIQI

SEQ ID NO: 10 - protein, 15 aa, Blattella germanica
ALREKVLGLPAIKAW

SEQ ID NO: 11 - protein, 15 aa, Blattella germanica
IRGRTKFEGNKFTID

SEQ ID NO: 12 - protein, 15 aa, Blattella germanica
NDIEKRVPFSHDDRL

SEQ ID NO: 13 - protein, 15 aa, Blattella germanica
HMAKEDLVANQPNLK

SEQ ID NO: 14 - protein, 15 aa, Blattella germanica
VLEKLEAGFAKLAAS

SEQ ID NO: 15 - protein, 15 aa, Blattella germanica
NYAIVEGCPAAANGH

SEQ ID NO: 16 - protein, 15 aa, Blattella germanica
GIRIYVDVVLNQMSG

SEQ ID NO: 17 - protein, 15 aa, Blattella germanica
RWRQIFNMVGFRNAV

SEQ ID NO: 18 - protein, 15 aa, Blattella germanica
NIACLLHNKYDSTKS

SEQ ID NO: 19 - protein, 15 aa, Blattella germanica
NGGYLAAGKLTWADF

SEQ ID NO: 20 - protein, 15 aa, Blattella germanica
LNIFTNNLGRINTHV

SEQ ID NO: 21 - protein, 15 aa, Blattella germanica
KTPVLEIDGKQTHQS

SEQ ID NO: 22 - protein, 15 aa, Blattella germanica
PAYFKMNSPSLWKYN

SEQ ID NO: 23 - protein, 15 aa, Blattella germanica
PKSMLLNIFTNNLGR

SEQ ID NO: 24 - protein, 15 aa, Blattella germanica
FETIVVTVDSLPEFK

SEQ ID NO: 25 - protein, 15 aa, Blattella germanica
LIDDVLAILPLDDLK

SEQ ID NO: 26 - protein, 15 aa, Blattella germanica
FAVATITHAAELQRV

SEQ ID NO: 27 - protein, 15 aa, Blattella germanica
PLYKLVHVFINTQYA

SEQ ID NO: 28 - protein, 15 aa, Blattella germanica
GNQNFLTVFDSTSCN

SEQ ID NO: 29 - protein, 14 aa, Blattella germanica
ISSQYYIQQNGNLC

SEQ ID NO: 30 - protein, 15 aa, Blattella germanica
HFFIGDFFVDHYYSE

SEQ ID NO: 31 - protein, 15 aa, Blattella germanica
GEPIRFLLSYGEKDF

SEQ ID NO: 32 - protein, 15 aa, Blattella germanica
FLLSYGEKDFEDYRF

SEQ ID NO: 33 - protein, 15 aa, Blattella germanica
SMPFGKTPVLEIDGK

SEQ ID NO: 34 - protein, 15 aa, Blattella germanica
VAISRYLGKQFGLSG

SEQ ID NO: 35 - protein, 15 aa, Blattella germanica
ISDFRAAIANYHYDA

SEQ ID NO: 36 - protein, 15 aa, Blattella germanica
YFVAILDYLNHMAKE

SEQ ID NO: 37 - protein, 15 aa, Blattella germanica
HMAKEDLVANQPNLK

SEQ ID NO: 38 - protein, 15 aa, Blattella germanica
DLVANQPNLKALREK

SEQ ID NO: 39 - protein, 15 aa, Blattella germanica
ALREKVLGLPAIKAW

SEQ ID NO: 40 - protein, 15 aa, Blattella germanica
VLGLPAIKAWVAKRP

SEQ ID NO: 41 - protein, 15 aa, Blattella germanica
EQISVLRKAFDAFDR

SEQ ID NO: 42 - protein, 15 aa, Blattella germanica
LRKAFDAFDREKSGS

SEQ ID NO: 43 - protein, 15 aa, Blattella germanica
EFVTLAAKFIIEEDS

SEQ ID NO: 44 - protein, 15 aa, Blattella germanica
EAMEKELREAFRLYD

SEQ ID NO: 45 - protein, 15 aa, Blattella germanica
SGTVDFDEFMEMMTG

SEQ ID NO: 46 - protein, 15 aa, Blattella germanica
NAIEFLNNIHDLLGI

SEQ ID NO: 47 - protein, 15 aa, Blattella germanica
IDDIIAILPVDDLYA

SEQ ID NO: 48 - protein, 15 aa, Blattella germanica
LIPVDQIIAIATDYL

SEQ ID NO: 49 - protein, 15 aa, Blattella germanica
QIIAIATDYLANDAE

SEQ ID NO: 50 - protein, 15 aa, Blattella germanica
ATDYLANDAEVQAAV

SEQ ID NO: 51 - protein, 15 aa, Blattella germanica
EYQNLIQKLKDKGVD

SEQ ID NO: 52 - protein, 15 aa, Blattella germanica
IQKLKDKGVDVDHII

SEQ ID NO: 53 - protein, 15 aa, Blattella germanica
DKGVDVDHIIELIHQ

SEQ ID NO: 54 - protein, 15 aa, Blattella germanica
DTRGLPEDLQDFLAL

SEQ ID NO: 55 - protein, 15 aa, Blattella germanica
LIPTDQVLAIAADYL

SEQ ID NO: 56 - protein, 15 aa, Blattella germanica
QVLAIAADYLANDAE

SEQ ID NO: 57 - protein, 15 aa, Blattella germanica
LKALFNEKLETSPDF

SEQ ID NO: 58 - protein, 15 aa, Blattella germanica
EYLKSDEFETIVVTV

SEQ ID NO: 59 - protein, 15 aa, Blattella germanica
DEFETIVVTVDSLPE

SEQ ID NO: 60 - protein, 15 aa, Blattella germanica
IVVTVDSLPEFKNFL

SEQ ID NO: 61 - protein, 15 aa, Blattella germanica
DDLQDFLALIPVDQI

SEQ ID NO: 62 - protein, 15 aa, Blattella germanica
PVDQIIAIATDYLAN

SEQ ID NO: 63 - protein, 15 aa, Blattella germanica
IAIATDYLANDAEVQ

SEQ ID NO: 64 - protein, 15 aa, Blattella germanica
DYLANDAEVQAAVAY

SEQ ID NO: 65 - protein, 15 aa, Blattella germanica
DAEVQAAVAYLQSDE

SEQ ID NO: 66 - protein, 15 aa, Blattella germanica
AAVAYLQSDEFETIV

SEQ ID NO: 67 - protein, 15 aa, Blattella germanica
VTLDALPELQNFLNF

SEQ ID NO: 68 - protein, 15 aa, Blattella germanica
LPELQNFLNFLEANG

SEQ ID NO: 69 - protein, 15 aa, Blattella germanica
HDLLGIPHIPVSGRK

SEQ ID NO: 70 - protein, 15 aa, Blattella germanica
IPHIPVSGRKYHIRR

SEQ ID NO: 71 - protein, 15 aa, Blattella germanica
VSGRKYHIRRGVGIT

SEQ ID NO: 72 - protein, 15 aa, Blattella germanica
PIDQILAIAADYLAN

SEQ ID NO: 73 - protein, 15 aa, Blattella germanica
DYLANDAEVQAAVEY

SEQ ID NO: 74 - protein, 15 aa, Blattella germanica
VTVDSLPEFKNFLNF

SEQ ID NO: 75 - protein, 15 aa, Blattella germanica
LQTNGLNAIEFINNI

SEQ ID NO: 76 - protein, 15 aa, Blattella germanica
LNAIEFINNIHDLLG

SEQ ID NO: 77 - protein, 15 aa, Blattella germanica
ATGRKHVRRGVGING

SEQ ID NO: 78 - protein, 15 aa, Blattella germanica
HVRRGVGINGLIDDV

SEQ ID NO: 79 - protein, 15 aa, Blattella germanica
VGINGLIDDVIAILP

SEQ ID NO: 80 - protein, 15 aa, Blattella germanica
IAILPVDELYALFQE

SEQ ID NO: 81 - protein, 15 aa, Blattella germanica
KLESSPEFKALYDAI

SEQ ID NO: 82 - protein, 15 aa, Blattella germanica
PEFKALYDAIRSPEF

SEQ ID NO: 83 - protein, 15 aa, Blattella germanica
LYDAIRSPEFQSIVQ

SEQ ID NO: 84 - protein, 15 aa, Blattella germanica
RSPEFQSIVQTLKAM

SEQ ID NO: 85 - protein, 15 aa, Blattella germanica
QSIVQTLKAMPEYQD

SEQ ID NO: 86 - protein, 15 aa, Blattella germanica
TLKAMPEYQDLIQRL

SEQ ID NO: 87 - protein, 15 aa, Blattella germanica
IHENLIVTSPFRPWW

SEQ ID NO: 88 - protein, 15 aa, Blattella germanica
FRPWWERYQLVSYNL

SEQ ID NO: 89 - protein, 15 aa, Blattella germanica
ERYQLVSYNLNSRSG

SEQ ID NO: 90 - protein, 15 aa, Blattella germanica
RCNNVGIRIYVDVVL

SEQ ID NO: 91 - protein, 15 aa, Blattella germanica
GIRIYVDVVLNQMSG

SEQ ID NO: 92 - protein, 15 aa, Blattella germanica
RGNNAIKWLVNFGVG

SEQ ID NO: 93 - protein, 15 aa, Blattella germanica
GASILTYKTSKLYKM

SEQ ID NO: 94 - protein, 15 aa, Blattella germanica
KLYKMAVAFMLAYPY

SEQ ID NO: 95 - protein, 15 aa, Blattella germanica
WVCEHRWRQIFNMVG

SEQ ID NO: 96 - protein, 15 aa, Blattella germanica
RWRQIFNMVGFRNAV

SEQ ID NO: 97 - protein, 15 aa, Blattella germanica
LTVFDSTSCNVVVAS

SEQ ID NO: 98 - protein, 15 aa, Blattella germanica
STSCNVVVASQECVG

SEQ ID NO: 99 - protein, 15 aa, Blattella germanica
GRGIEDSLTISNLTT

SEQ ID NO: 100 - protein, 15 aa, Blattella germanica
SQQDIVLADELSQEV

SEQ ID NO: 101 - protein, 15 aa, Blattella germanica
AVLALCATDTLANED

SEQ ID NO: 102 - protein, 15 aa, Blattella germanica
CATDTLANEDCFRHE

SEQ ID NO: 103 - protein, 15 aa, Blattella germanica
LANEDCFRHESLVPN

SEQ ID NO: 104 - protein, 15 aa, Blattella germanica
PYSVLATDYENYAIV

SEQ ID NO: 105 - protein, 15 aa, Blattella germanica
VNQHKKAIEEDLKHF

SEQ ID NO: 106 - protein, 15 aa, Blattella germanica
KHFNLKYEDLHSTCH

SEQ ID NO: 107 - protein, 15 aa, Blattella germanica
MAPSYKLTYCPVKAL

SEQ ID NO: 108 - protein, 15 aa, Blattella germanica
KLTYCPVKALGEPIR

SEQ ID NO: 109 - protein, 15 aa, Blattella germanica
FLLSYGEKDFEDYRF

SEQ ID NO: 110 - protein, 15 aa, Blattella germanica
GEKDFEDYRFQEGDW

SEQ ID NO: 111 - protein, 15 aa, Blattella germanica
PNLKPSMPFGKTPVL

SEQ ID NO: 112 - protein, 15 aa, Blattella germanica
QTHQSVAISRYLGKQ

SEQ ID NO: 113 - protein, 15 aa, Blattella germanica
VAISRYLGKQFGLSG

SEQ ID NO: 114 - protein, 15 aa, Blattella germanica
YLGKQFGLSGKDDWE

SEQ ID NO: 115 - protein, 15 aa, Blattella germanica
KDDWENLEIDMIVDT

SEQ ID NO: 116 - protein, 15 aa, Blattella germanica
NLEIDMIVDTISDFR

SEQ ID NO: 117 - protein, 15 aa, Blattella germanica
MIVDTISDFRAAIAN

SEQ ID NO: 118 - protein, 15 aa, Blattella germanica
ISDFRAAIANYHYDA

SEQ ID NO: 119 - protein, 15 aa, Blattella germanica
AAIANYHYDADENSK

SEQ ID NO: 120 - protein, 15 aa, Blattella germanica
YHYDADENSKQKKWD

SEQ ID NO: 121 - protein, 15 aa, Blattella germanica
EVVKANGGYLAAGKL

SEQ ID NO: 122 - protein, 15 aa, Blattella germanica
NGGYLAAGKLTWADF

SEQ ID NO: 123 - protein, 15 aa, Blattella germanica
AAGKLTWADFYFVAI

SEQ ID NO: 124 - protein, 15 aa, Blattella germanica
HMAKEDLVANQPNLK

SEQ ID NO: 125 - protein, 15 aa, Blattella germanica
DLVANQPNLKALREK

SEQ ID NO: 126 - protein, 15 aa, Blattella germanica
AAKFIIEEDSEAMEK

SEQ ID NO: 127 - protein, 15 aa, Blattella germanica
IEEDSEAMEKELREA

SEQ ID NO: 128 - protein, 15 aa, Blattella germanica
EAMEKELREAFRLYD

SEQ ID NO: 129 - protein, 15 aa, Blattella germanica
ELREAFRLYDKEGNG

SEQ ID NO: 130 - protein, 15 aa, Blattella germanica
FRLYDKEGNGYIPTS

SEQ ID NO: 131 - protein, 15 aa, Blattella germanica
KEGNGYIPTSCLREI

SEQ ID NO: 132 - protein, 15 aa, Blattella germanica
YIPTSCLREILRELD

SEQ ID NO: 133 - protein, 15 aa, Blattella germanica
DELDMMIEEIDADGS

SEQ ID NO: 134 - protein, 15 aa, Blattella germanica
KALQNAESEVAALNR

SEQ ID NO: 135 - protein, 15 aa, Blattella germanica
RSEERLATATAKLAE

SEQ ID NO: 136 - protein, 15 aa, Blattella germanica
VQKLQKEVDRLEDEL

SEQ ID NO: 137 - protein, 15 aa, Blattella germanica
KEVDRLEDELVHEKE

SEQ ID NO: 138 - protein, 15 aa, Blattella germanica
EAGFAKLAASDSKSL

SEQ ID NO: 139 - protein, 15 aa, Blattella germanica
KLAASDSKSLLRKYL

SEQ ID NO: 140 - protein, 15 aa, Blattella germanica
RCGRSMQGYPFNPCL

SEQ ID NO: 141 - protein, 15 aa, Blattella germanica
LIDDHFLFKEGDRFL

SEQ ID NO: 142 - protein, 15 aa, Blattella germanica
FLFKEGDRFLQHANA

SEQ ID NO: 143 - protein, 15 aa, Blattella germanica
WCNEEDHLRIISMQM

SEQ ID NO: 144 - protein, 15 aa, Blattella germanica
QVYRRLVTAVNDIEK

SEQ ID NO: 145 - protein, 15 aa, Blattella germanica
RVPFSHDDRLGFLTF

SEQ ID NO: 146 - protein, 15 aa, Blattella germanica
HDDRLGFLTFCPTNL

SEQ ID NO: 147 - protein, 15 aa, Blattella germanica
CPTNLGTTVRASVRI

SEQ ID NO: 148 - protein, 15 aa, Blattella germanica
SPYFVTNTEKMITEF

SEQ ID NO: 149 - protein, 15 aa, Blattella germanica
KIGEYKNMIAEGIID

SEQ ID NO: 150 - protein, 15 aa, Blattella germanica
RHNSAYKLHFNAFEY

SEQ ID NO: 151 - protein, 15 aa, Blattella germanica
STSLVKAHSMRNSAS

SEQ ID NO: 152 - protein, 15 aa, Blattella germanica
AVRLSKDIAADLQGE

SEQ ID NO: 153 - protein, 15 aa, Blattella germanica
LVRLLKQLKVSQIME

SEQ ID NO: 154 - protein, 15 aa, Blattella germanica
KQLKVSQIMEAARKL

SEQ ID NO: 155 - protein, 15 aa, Blattella germanica
QQFISSEMVEPKEAS

SEQ ID NO: 156 - protein, 15 aa, Blattella germanica
KNMTYVNTSLVLAFS

SEQ ID NO: 157 - protein, 15 aa, Blattella germanica
QKGYMVSSMTDLWEA

SEQ ID NO: 158 - protein, 15 aa, Blattella germanica
NTTFSNASAVIQEFL

SEQ ID NO: 159 - protein, 15 aa, Blattella germanica
PAYFKMNSPSLWKYN

SEQ ID NO: 160 - protein, 15 aa, Blattella germanica
MNITGSINLMFSQMY

SEQ ID NO: 161 - protein, 15 aa, Blattella germanica
SINLMFSQMYHAQLA

SEQ ID NO: 162 - protein, 15 aa, Blattella germanica
FSQMYHAQLAFSTAF

SEQ ID NO: 163 - protein, 15 aa, Blattella germanica
FQINLDFKNHNGFIR

SEQ ID NO: 164 - protein, 15 aa, Blattella germanica
DVLQWQTIPYTTIHN

SEQ ID NO: 165 - protein, 15 aa, Blattella germanica
VPIMNIYSAFEFDPN

SEQ ID NO: 166 - protein, 15 aa, Blattella germanica
LRLSEHLDYVKNLTV

SEQ ID NO: 167 - protein, 15 aa, Blattella germanica
AKRFAKWALPLYNKP

SEQ ID NO: 168 - protein, 15 aa, Blattella germanica
HIVFPSYEIEMFYDG

SEQ ID NO: 169 - protein, 15 aa, Blattella germanica
SYEIEMFYDGSRIMI

SEQ ID NO: 170 - protein, 15 aa, Blattella germanica
RILLRLHRCFQVLGR

SEQ ID NO: 171 - protein, 15 aa, Blattella germanica
IRHAILAAGDLYSRR

SEQ ID NO: 172 - protein, 15 aa, Blattella germanica
QSYETKLLFDLFYYA

SEQ ID NO: 173 - protein, 15 aa, Blattella germanica
KLLFDLFYYANDYDT

SEQ ID NO: 174 - protein, 15 aa, Blattella germanica
HINEGQFLYALSSAL

SEQ ID NO: 175 - protein, 15 aa, Blattella germanica
QFLYALSSALFQRED

SEQ ID NO: 176 - protein, 15 aa, Blattella germanica
LNDYILPAPYEIYPW

SEQ ID NO: 177 - protein, 15 aa, Blattella germanica
EIYPWLFVDSDVIQR

SEQ ID NO: 178 - protein, 15 aa, Blattella germanica
LNTYYSYYYFNYPTF

SEQ ID NO: 179 - protein, 15 aa, Blattella germanica
SYYYFNYPTFFNSTE

SEQ ID NO: 180 - protein, 15 aa, Blattella germanica
DRRGEMFYYTRQQLY

SEQ ID NO: 181 - protein, 15 aa, Blattella germanica
MFYYTRQQLYARYFL

SEQ ID NO: 182 - protein, 15 aa, Blattella germanica
RQQLYARYFLERLSN

SEQ ID NO: 183 - protein, 15 aa, Blattella germanica
ARYFLERLSNDLPDV

SEQ ID NO: 184 - protein, 15 aa, Blattella germanica
QATDAYVRVFLGPKY

SEQ ID NO: 185 - protein, 15 aa, Blattella germanica
KELVEKYGKGKAIFI

SEQ ID NO: 186 - protein, 15 aa, Blattella germanica
EDAFKKAYNAFKSLD

SEQ ID NO: 187 - protein, 15 aa, Blattella germanica
AKGMMHMIKKGANGS

SEQ ID NO: 188 - protein, 15 aa, Blattella germanica
VYEVAIPDRLTLRVE

SEQ ID NO: 189 - protein, 15 aa, Blattella germanica
QTLFLLLLLLAAVSA

SEQ ID NO: 190 - protein, 15 aa, Blattella germanica
SLLLNGGCKVSNYDE

SEQ ID NO: 191 - protein, 15 aa, Blattella germanica
EVKIVATLKALQNAH

SEQ ID NO: 192 - protein, 15 aa, Blattella germanica
ISLEVLKNYQLDSEL

SEQ ID NO: 193 - protein, 15 aa, Blattella germanica
LKNYQLDSELRIKAF

SEQ ID NO: 194 - protein, 15 aa, Blattella germanica
QVGSFIVSYLRNLRA

SEQ ID NO: 195 - protein, 15 aa, Blattella germanica
THQFNVAGSVTVDKT

SEQ ID NO: 196 - protein, 15 aa, Blattella germanica
LNQEAHYQFDSIHKF

SEQ ID NO: 197 - protein, 15 aa, Blattella germanica
HYQFDSIHKFEFASK

SEQ ID NO: 198 - protein, 15 aa, Blattella germanica
KAAVHLLVAVKASKE

SEQ ID NO: 199 - protein, 15 aa, Blattella germanica
WVPSKKCHLTNIACL

SEQ ID NO: 200 - protein, 15 aa, Blattella germanica
KCHLTNIACLLHNKY

SEQ ID NO: 201 - protein, 15 aa, Blattella germanica
DVLDIGGLKVQKQTF

SEQ ID NO: 202 - protein, 15 aa, Blattella germanica
DRKMYWQFKMDKIQI

SEQ ID NO: 203 - protein, 15 aa, Blattella germanica
GHSHFVSDVVLSSDG

SEQ ID NO: 204 - protein, 15 aa, Blattella germanica
DCGVAGFRVDAAKHM

SEQ ID NO: 205 - protein, 15 aa, Blattella germanica
LDYERFRGSWIIAAG

SEQ ID NO: 206 - protein, 15 aa, Blattella germanica
KNRTTIRGRTKFEGN

SEQ ID NO: 207 - protein, 15 aa, Blattella germanica
IRGRTKFEGNKFTID

SEQ ID NO: 208 - protein, 15 aa, Blattella germanica
KFEGNKFTIDYNDKG

SEQ ID NO: 209 - protein, 15 aa, Blattella germanica
ATDYENYAIVEGCPA

SEQ ID NO: 210 - protein, 15 aa, Blattella germanica
NYAIVEGCPAAANGH

SEQ ID NO: 211 - protein, 15 aa, Blattella germanica
VIYVQIRFSVRRFHP

SEQ ID NO: 212 - protein, 15 aa, Blattella germanica
IRFSVRRFHPKLGDK

SEQ ID NO: 213 - protein, 15 aa, Blattella germanica
KLGDKEMIQHYTLDQ

SEQ ID NO: 214 - protein, 15 aa, Blattella germanica
KAIEEDLKHFNLKYE

SEQ ID NO: 215 - protein, 15 aa, Blattella germanica
KTPVLEIDGKQTHQS

SEQ ID NO: 216 - protein, 15 aa, Blattella germanica
DENSKQKKWDPLKKE

SEQ ID NO: 217 - protein, 15 aa, Blattella germanica
QKKWDPLKKETIPYY

SEQ ID NO: 218 - protein, 15 aa, Blattella germanica
PLKKETIPYYTKKFD

SEQ ID NO: 219 - protein, 15 aa, Blattella germanica
TIPYYTKKFDEVVKA

SEQ ID NO: 220 - protein, 15 aa, Blattella germanica
TKKFDEVVKANGGYL

SEQ ID NO: 221 - protein, 15 aa, Blattella germanica
YFVAILDYLNHMAKE

SEQ ID NO: 222 - protein, 15 aa, Blattella germanica
QPNLKALREKVLGLP

SEQ ID NO: 223 - protein, 15 aa, Blattella germanica
ALREKVLGLPAIKAW

SEQ ID NO: 224 - protein, 15 aa, Blattella germanica
VLGLPAIKAWVAKRP

SEQ ID NO: 225 - protein, 15 aa, Blattella germanica
VLEKLEAGFAKLAAS

SEQ ID NO: 226 - protein, 15 aa, Blattella germanica
FGSTLLDVIQSGLEN

SEQ ID NO: 227 - protein, 15 aa, Blattella germanica
NDIEKRVPFSHDDRL

SEQ ID NO: 228 - protein, 15 aa, Blattella germanica
ALNSIQQFISSEMVE

SEQ ID NO: 229 - protein, 15 aa, Blattella germanica
VEALFLLMKADPSIH

SEQ ID NO: 230 - protein, 15 aa, Blattella germanica
DPSIHVLKMVAELTH

SEQ ID NO: 231 - protein, 15 aa, Blattella germanica
PKSMLLNIFTNNLGR

SEQ ID NO: 232 - protein, 15 aa, Blattella germanica
LNIFTNNLGRINTHV

SEQ ID NO: 233 - protein, 15 aa, Blattella germanica
KTLVKFVEGNLKYFN

SEQ ID NO: 234 - protein, 15 aa, Blattella germanica
LKYFNMGVQKFWAFD

SEQ ID NO: 235 - protein, 15 aa, Blattella germanica
MGVQKFWAFDNTTFS

SEQ ID NO: 236 - protein, 15 aa, Blattella germanica
NASAVIQEFLKTYKK

SEQ ID NO: 237 - protein, 15 aa, Blattella germanica
HTKLSSSSSITLTLP

SEQ ID NO: 238 - protein, 15 aa, Blattella germanica
SVNATVVRLQSWQSE

SEQ ID NO: 239 - protein, 15 aa, Blattella germanica
VVRLQSWQSEMLRMN

SEQ ID NO: 240 - protein, 15 aa, Blattella germanica
PRHGEQFYYFYQQIY

SEQ ID NO: 241 - protein, 15 aa, Blattella germanica
DYQSYRTLMRKVYDA

SEQ ID NO: 242 - protein, 15 aa, Blattella germanica
GQEYTFYVIVTPYAK

SEQ ID NO: 243 - protein, 15 aa, Blattella germanica
KAIFIKCDVTNIPEF

SEQ ID NO: 244 - protein, 15 aa, Blattella germanica
IVINNAGILNDEKWE

SEQ ID NO: 245 - protein, 15 aa, Blattella germanica
KEFANVVRVVRHTSK

SEQ ID NO: 246 - protein, 15 aa, Blattella germanica
RIKAFLALVECPCNK

SEQ ID NO: 247 - protein, 15 aa, Blattella germanica
FRKFSNNFEFSYLLG

SEQ ID NO: 248 - protein, 15 aa, Blattella germanica
NVIYSQNSFLPRATT

SEQ ID NO: 249 - protein, 15 aa, Blattella germanica
RLFGAEVGWLALHHN

SEQ ID NO: 250 - protein, 15 aa, Blattella germanica
LVYPTSLGFPLKLVL

SEQ ID NO: 251 - protein, 15 aa, Blattella germanica
SHVHFRFVPSAAVEF

SEQ ID NO: 252 - protein, 15 aa, Blattella germanica
KKLQFTYSESLDLDD

SEQ ID NO: 253 - protein, 15 aa, Blattella germanica
AQIQVVIHLDEQYIY

SEQ ID NO: 254 - protein, 15 aa, Blattella germanica
GVTPVFYNMVKQGLV

SEQ ID NO: 255 - protein, 15 aa, Blattella germanica
SEVTALNRQIGGTPI

SEQ ID NO: 256 - protein, 15 aa, Blattella germanica
GKDYILRVSQLGHTV

SEQ ID NO: 257 - protein, 15 aa, Blattella germanica
NAIEFLNNIHDLLGI

SEQ ID NO: 258 - protein, 15 aa, Blattella germanica
LNNIHDLLGIPHIPV

SEQ ID NO: 259 - protein, 15 aa, Blattella germanica
DLLGIPHIPVTARKH

SEQ ID NO: 260 - protein, 15 aa, Blattella germanica
PHIPVTARKHHRRGV

SEQ ID NO: 261 - protein, 15 aa, Blattella germanica
TARKHHRRGVGITGL

SEQ ID NO: 262 - protein, 15 aa, Blattella germanica
HRRGVGITGLIDDII

SEQ ID NO: 263 - protein, 15 aa, Blattella germanica
GITGLIDDIIAILPV

SEQ ID NO: 264 - protein, 15 aa, Blattella germanica
IDDIIAILPVDDLYA

SEQ ID NO: 265 - protein, 15 aa, Blattella germanica
AILPVDDLYALFQEK

SEQ ID NO: 266 - protein, 15 aa, Blattella germanica
DDLYALFQEKLETSP

SEQ ID NO: 267 - protein, 15 aa, Blattella germanica
LFQEKLETSPEFKAL

SEQ ID NO: 268 - protein, 15 aa, Blattella germanica
LETSPEFKALYDAIR

SEQ ID NO: 269 - protein, 15 aa, Blattella germanica
EFKALYDAIRSPEFQ

SEQ ID NO: 270 - protein, 15 aa, Blattella germanica
YDAIRSPEFQSIVGT

SEQ ID NO: 271 - protein, 15 aa, Blattella germanica
SPEFQSIVGTLEAMP

SEQ ID NO: 272 - protein, 15 aa, Blattella germanica
SIVGTLEAMPEYQNL

SEQ ID NO: 273 - protein, 15 aa, Blattella germanica
LEAMPEYQNLIQKLK

SEQ ID NO: 274 - protein, 15 aa, Blattella germanica
EYQNLIQKLKDKGVD

SEQ ID NO: 275 - protein, 15 aa, Blattella germanica
IQKLKDKGVDVDHII

SEQ ID NO: 276 - protein, 15 aa, Blattella germanica
DKGVDVDHIIELIHQ

SEQ ID NO: 277 - protein, 15 aa, Blattella germanica
VDHIIELIHQIFNIV

SEQ ID NO: 278 - protein, 15 aa, Blattella germanica
ELIHQIFNIVRDTRG

SEQ ID NO: 279 - protein, 15 aa, Blattella germanica
IFNIVRDTRGLPEDL

SEQ ID NO: 280 - protein, 15 aa, Blattella germanica
RDTRGLPEDLQDFLA

SEQ ID NO: 281 - protein, 15 aa, Blattella germanica
DTRGLPEDLQDFLAL

SEQ ID NO: 282 - protein, 15 aa, Blattella germanica
LPEDLQDFLALIPTD

SEQ ID NO: 283 - protein, 15 aa, Blattella germanica
QDFLALIPTDQVLAI

SEQ ID NO: 284 - protein, 15 aa, Blattella germanica
LIPTDQVLAIAADYL

SEQ ID NO: 285 - protein, 15 aa, Blattella germanica
QVLAIAADYLANDAE

SEQ ID NO: 286 - protein, 15 aa, Blattella germanica
AADYLANDAEVKAAV

SEQ ID NO: 287 - protein, 15 aa, Blattella germanica
ANDAEVKAAVEYLKS

SEQ ID NO: 288 - protein, 15 aa, Blattella germanica
VKAAVEYLKSDEFET

SEQ ID NO: 289 - protein, 15 aa, Blattella germanica
EYLKSDEFETIVVTV

SEQ ID NO: 290 - protein, 15 aa, Blattella germanica
DEFETIVVTVDSLPE

SEQ ID NO: 291 - protein, 15 aa, Blattella germanica
IVVTVDSLPEFKNFL

SEQ ID NO: 292 - protein, 15 aa, Blattella germanica
DSLPEFKNFLNFLQT

SEQ ID NO: 293 - protein, 15 aa, Blattella germanica
FKNFLNFLQTNGLNA

SEQ ID NO: 294 - protein, 15 aa, Blattella germanica
NFLQTNGLNAIEFLN

SEQ ID NO: 295 - protein, 15 aa, Blattella germanica
NGLNAIEFLNNIHDL

SEQ ID NO: 296 - protein, 15 aa, Blattella germanica
IEFLNNIHDLLGIPH

SEQ ID NO: 297 - protein, 15 aa, Blattella germanica
NIHDLLGIPHIPVTG

SEQ ID NO: 298 - protein, 15 aa, Blattella germanica
LGIPHIPVTGRKHLR

SEQ ID NO: 299 - protein, 15 aa, Blattella germanica
IPVTGRKHLRRGVGI

SEQ ID NO: 300 - protein, 15 aa, Blattella germanica
RKHLRRGVGITGLID

SEQ ID NO: 301 - protein, 15 aa, Blattella germanica
HLRRGVGITGLIDDI

SEQ ID NO: 302 - protein, 15 aa, Blattella germanica
RGVGITGLIDDIIAI

SEQ ID NO: 303 - protein, 15 aa, Blattella germanica
TGLIDDIIAILPVDD

SEQ ID NO: 304 - protein, 15 aa, Blattella germanica
DIIAILPVDDLYALF

SEQ ID NO: 305 - protein, 15 aa, Blattella germanica
LPVDDLYALFQEKLE

SEQ ID NO: 306 - protein, 15 aa, Blattella germanica
LYALFQEKLETSPEF

SEQ ID NO: 307 - protein, 15 aa, Blattella germanica
QEKLETSPEFKALYD

SEQ ID NO: 308 - protein, 15 aa, Blattella germanica
TSPEFKALYDAIRSP

SEQ ID NO: 309 - protein, 15 aa, Blattella germanica
KALYDAIRSPEFQSI

SEQ ID NO: 310 - protein, 15 aa, Blattella germanica
AIRSPEFQSIVETLK

SEQ ID NO: 311 - protein, 15 aa, Blattella germanica
EFQSIVETLKAMPEY

SEQ ID NO: 312 - protein, 15 aa, Blattella germanica
VETLKAMPEYQSLIQ

SEQ ID NO: 313 - protein, 15 aa, Blattella germanica
AMPEYQSLIQKLKDK

SEQ ID NO: 314 - protein, 15 aa, Blattella germanica
QSLIQKLKDKGVDVD

SEQ ID NO: 315 - protein, 15 aa, Blattella germanica
KLKDKGVDVDHIIEL

SEQ ID NO: 316 - protein, 15 aa, Blattella germanica
GVDVDHIIELIHQIF

SEQ ID NO: 317 - protein, 15 aa, Blattella germanica
HIIELIHQIFNIVRD

SEQ ID NO: 318 - protein, 15 aa, Blattella germanica
IHQIFNIVRDTRGLP

SEQ ID NO: 319 - protein, 15 aa, Blattella germanica
NIVRDTRGLPEDLQD

SEQ ID NO: 320 - protein, 15 aa, Blattella germanica
DTRGLPEDLQDFLAL

SEQ ID NO: 321 - protein, 15 aa, Blattella germanica
TRGLPEDLQDFLALI

SEQ ID NO: 322 - protein, 15 aa, Blattella germanica
EDLQDFLALIPIDQI

SEQ ID NO: 323 - protein, 15 aa, Blattella germanica
FLALIPIDQILAIAA

SEQ ID NO: 324 - protein, 15 aa, Blattella germanica
PIDQILAIAADYLAN

SEQ ID NO: 325 - protein, 15 aa, Blattella germanica
LAIAADYLANDAEVQ

SEQ ID NO: 326 - protein, 15 aa, Blattella germanica
DYLANDAEVQAAVEY

SEQ ID NO: 327 - protein, 15 aa, Blattella germanica
DAEVQAAVEYLKSDE

SEQ ID NO: 328 - protein, 15 aa, Blattella germanica
AAVEYLKSDEFETIV

SEQ ID NO: 329 - protein, 15 aa, Blattella germanica
LKSDEFETIVVTVDS

SEQ ID NO: 330 - protein, 15 aa, Blattella germanica
FETIVVTVDSLPEFK

SEQ ID NO: 331 - protein, 15 aa, Blattella germanica
VTVDSLPEFKNFLNF

SEQ ID NO: 332 - protein, 15 aa, Blattella germanica
LPEFKNFLNFLQTNG

SEQ ID NO: 333 - protein, 15 aa, Blattella germanica
NFLNFLQTNGLNAIE

SEQ ID NO: 334 - protein, 15 aa, Blattella germanica
LQTNGLNAIEFINNI

SEQ ID NO: 335 - protein, 15 aa, Blattella germanica
LNAIEFINNIHDLLG

SEQ ID NO: 336 - protein, 15 aa, Blattella germanica
FINNIHDLLGIPHIP

SEQ ID NO: 337 - protein, 15 aa, Blattella germanica
HDLLGIPHIPATGRK

SEQ ID NO: 338 - protein, 15 aa, Blattella germanica
IPHIPATGRKHVRRG

SEQ ID NO: 339 - protein, 15 aa, Blattella germanica
ATGRKHVRRGVGING

SEQ ID NO: 340 - protein, 15 aa, Blattella germanica
HVRRGVGINGLIDDV

SEQ ID NO: 341 - protein, 15 aa, Blattella germanica
VGINGLIDDVIAILP

SEQ ID NO: 342 - protein, 15 aa, Blattella germanica
LIDDVIAILPVDELY

SEQ ID NO: 343 - protein, 15 aa, Blattella germanica
IAILPVDELYALFQE

SEQ ID NO: 344 - protein, 15 aa, Blattella germanica
VDELYALFQEKLESS

SEQ ID NO: 345 - protein, 15 aa, Blattella germanica
ALFQEKLESSPEFKA

SEQ ID NO: 346 - protein, 15 aa, Blattella germanica
KLESSPEFKALYDAI

SEQ ID NO: 347 - protein, 15 aa, Blattella germanica
PEFKALYDAIRSPEF

SEQ ID NO: 348 - protein, 15 aa, Blattella germanica
LYDAIRSPEFQSIVQ

SEQ ID NO: 349 - protein, 15 aa, Blattella germanica
RSPEFQSIVQTLKAM

SEQ ID NO: 350 - protein, 15 aa, Blattella germanica
QSIVQTLKAMPEYQD

SEQ ID NO: 351 - protein, 15 aa, Blattella germanica
TLKAMPEYQDLIQRL

SEQ ID NO: 352 - protein, 15 aa, Blattella germanica
PEYQDLIQRLKDKGV

SEQ ID NO: 353 - protein, 15 aa, Blattella germanica
LIQRLKDKGVDVDHF

SEQ ID NO: 354 - protein, 15 aa, Blattella germanica
KDKGVDVDHFIELIK

SEQ ID NO: 355 - protein, 15 aa, Blattella germanica
DVDHFIELIKKLFGL

SEQ ID NO: 356 - protein, 15 aa, Blattella germanica
DHFIELIKKLFGLSH

SEQ ID NO: 357 - protein, 15 aa, Blattella germanica
NLLEKLREKGVDVDK

SEQ ID NO: 358 - protein, 15 aa, Blattella germanica
LEKLREKGVDVDKII

SEQ ID NO: 359 - protein, 15 aa, Blattella germanica
EKGVDVDKIIELIRA

SEQ ID NO: 360 - protein, 15 aa, Blattella germanica
VDKIIELIRALFGLT

SEQ ID NO: 361 - protein, 15 aa, Blattella germanica
KIIELIRALFGLTLN

SEQ ID NO: 362 - protein, 15 aa, Blattella germanica
IRALFGLTLNAKASR

SEQ ID NO: 363 - protein, 15 aa, Blattella germanica
GLTLNAKASRNLQDD

SEQ ID NO: 364 - protein, 15 aa, Blattella germanica
AKASRNLQDDLQDFL

SEQ ID NO: 365 - protein, 15 aa, Blattella germanica
KASRNLQDDLQDFLA

SEQ ID NO: 366 - protein, 15 aa, Blattella germanica
ASRNLQDDLQDFLAL

SEQ ID NO: 367 - protein, 15 aa, Blattella germanica
LQDDLQDFLALIPVD

SEQ ID NO: 368 - protein, 15 aa, Blattella germanica
QDFLALIPVDQIIAI

SEQ ID NO: 369 - protein, 15 aa, Blattella germanica
LIPVDQIIAIATDYL

SEQ ID NO: 370 - protein, 15 aa, Blattella germanica
QIIAIATDYLANDAE

SEQ ID NO: 371 - protein, 15 aa, Blattella germanica
ATDYLANDAEVQAAV

SEQ ID NO: 372 - protein, 15 aa, Blattella germanica
ANDAEVQAAVAYLQS

SEQ ID NO: 373 - protein, 15 aa, Blattella germanica
VQAAVAYLQSDEFET

SEQ ID NO: 374 - protein, 15 aa, Blattella germanica
AYLQSDEFETIVVAL

SEQ ID NO: 375 - protein, 15 aa, Blattella germanica
DEFETIVVALDALPE

SEQ ID NO: 376 - protein, 15 aa, Blattella germanica
IVVALDALPELQNFL

SEQ ID NO: 377 - protein, 15 aa, Blattella germanica
DALPELQNFLNFLEA

SEQ ID NO: 378 - protein, 15 aa, Blattella germanica
LQNFLNFLEANGLNA

SEQ ID NO: 379 - protein, 15 aa, Blattella germanica
NFLEANGLNAIDFLN

SEQ ID NO: 380 - protein, 15 aa, Blattella germanica
NGLNAIDFLNGIHDL

SEQ ID NO: 381 - protein, 15 aa, Blattella germanica
IDFLNGIHDLLGIPH

SEQ ID NO: 382 - protein, 15 aa, Blattella germanica
GIHDLLGIPHIPVSG

SEQ ID NO: 383 - protein, 15 aa, Blattella germanica
DLLGIPHIPVSGRKY

SEQ ID NO: 384 - protein, 15 aa, Blattella germanica
PHIPVSGRKYHIRRG

SEQ ID NO: 385 - protein, 15 aa, Blattella germanica
SGRKYHIRRGVGITG

SEQ ID NO: 386 - protein, 15 aa, Blattella germanica
YHIRRGVGITGLIDD

SEQ ID NO: 387 - protein, 15 aa, Blattella germanica
HIRRGVGITGLIDDV

SEQ ID NO: 388 - protein, 15 aa, Blattella germanica
RGVGITGLIDDVLAI

SEQ ID NO: 389 - protein, 15 aa, Blattella germanica
TGLIDDVLAILPIED

SEQ ID NO: 390 - protein, 15 aa, Blattella germanica
DVLAILPIEDLKALF

SEQ ID NO: 391 - protein, 15 aa, Blattella germanica
LPIEDLKALFNEKLE

SEQ ID NO: 392 - protein, 15 aa, Blattella germanica
LKALFNEKLETSPDF

SEQ ID NO: 393 - protein, 15 aa, Blattella germanica
NEKLETSPDFLALYN

SEQ ID NO: 394 - protein, 15 aa, Blattella germanica
TSPDFLALYNAIRSP

SEQ ID NO: 395 - protein, 15 aa, Blattella germanica
LALYNAIRSPEFQSI

SEQ ID NO: 396 - protein, 15 aa, Blattella germanica
AIRSPEFQSIVQTLN

SEQ ID NO: 397 - protein, 15 aa, Blattella germanica
EFQSIVQTLNAMPEY

SEQ ID NO: 398 - protein, 15 aa, Blattella germanica
VQTLNAMPEYQNLLQ

SEQ ID NO: 399 - protein, 15 aa, Blattella germanica
AMPEYQNLLQKLREK

SEQ ID NO: 400 - protein, 15 aa, Blattella germanica
QNLLQKLREKGVDVD

SEQ ID NO: 401 - protein, 15 aa, Blattella germanica
KLREKGVDVDKIIEL

SEQ ID NO: 402 - protein, 15 aa, Blattella germanica
GVDVDKIIELIRALF

SEQ ID NO: 403 - protein, 15 aa, Blattella germanica
KIIELIRALFGLTLN

SEQ ID NO: 404 - protein, 15 aa, Blattella germanica
IRALFGLTLNGKASR

SEQ ID NO: 405 - protein, 15 aa, Blattella germanica
GLTLNGKASRNLQDD

SEQ ID NO: 406 - protein, 15 aa, Blattella germanica
LNGKASRNLQDDLQD

SEQ ID NO: 407 - protein, 15 aa, Blattella germanica
GKASRNLQDDLQDFL

SEQ ID NO: 408 - protein, 15 aa, Blattella germanica
KASRNLQDDLQDFLA

SEQ ID NO: 409 - protein, 15 aa, Blattella germanica
ASRNLQDDLQDFLAL

SEQ ID NO: 410 - protein, 15 aa, Blattella germanica
SRNLQDDLQDFLALI

SEQ ID NO: 411 - protein, 15 aa, Blattella germanica
DDLQDFLALIPVDQI

SEQ ID NO: 412 - protein, 15 aa, Blattella germanica
FLALIPVDQIIAIAT

SEQ ID NO: 413 - protein, 15 aa, Blattella germanica
PVDQIIAIATDYLAN

SEQ ID NO: 414 - protein, 15 aa, Blattella germanica
IAIATDYLANDAEVQ

SEQ ID NO: 415 - protein, 15 aa, Blattella germanica
DYLANDAEVQAAVAY

SEQ ID NO: 416 - protein, 15 aa, Blattella germanica
DAEVQAAVAYLQSDE

SEQ ID NO: 417 - protein, 15 aa, Blattella germanica
AAVAYLQSDEFETIV

SEQ ID NO: 418 - protein, 15 aa, Blattella germanica
LQSDEFETIVVTLDA

SEQ ID NO: 419 - protein, 15 aa, Blattella germanica
FETIVVTLDALPELQ

SEQ ID NO: 420 - protein, 15 aa, Blattella germanica
VTLDALPELQNFLNF

SEQ ID NO: 421 - protein, 15 aa, Blattella germanica
LPELQNFLNFLEANG

SEQ ID NO: 422 - protein, 15 aa, Blattella germanica
NFLNFLEANGLNAID

SEQ ID NO: 423 - protein, 15 aa, Blattella germanica
LEANGLNAIDFLNGI

SEQ ID NO: 424 - protein, 15 aa, Blattella germanica
LNAIDFLNGIHDLLG

SEQ ID NO: 425 - protein, 15 aa, Blattella germanica
FLNGIHDLLGIPHIP

SEQ ID NO: 426 - protein, 15 aa, Blattella germanica
HDLLGIPHIPVSGRK

SEQ ID NO: 427 - protein, 15 aa, Blattella germanica
IPHIPVSGRKYHIRR

SEQ ID NO: 428 - protein, 15 aa, Blattella germanica
VSGRKYHIRRGVGIT

SEQ ID NO: 429 - protein, 15 aa, Blattella germanica
HIRRGVGITGLIDDV

SEQ ID NO: 430 - protein, 15 aa, Blattella germanica
VGITGLIDDVLAILP

SEQ ID NO: 431 - protein, 15 aa, Blattella germanica
LIDDVLAILPLDDLK

SEQ ID NO: 432 - protein, 15 aa, Blattella germanica
LAILPLDDLKALFNE

SEQ ID NO: 433 - protein, 15 aa, Blattella germanica
LDDLKALFNEKLETS

SEQ ID NO: 434 - protein, 15 aa, Blattella germanica
ALFNEKLETSPDFLA

SEQ ID NO: 435 - protein, 15 aa, Blattella germanica
KLETSPDFLALYNAI

SEQ ID NO: 436 - protein, 15 aa, Blattella germanica
PDFLALYNAIKSPEF

SEQ ID NO: 437 - protein, 15 aa, Blattella germanica
LYNAIKSPEFQSIVQ

SEQ ID NO: 438 - protein, 15 aa, Blattella germanica
KSPEFQSIVQTLNAM

SEQ ID NO: 439 - protein, 15 aa, Blattella germanica
QSIVQTLNAMPEYQN

SEQ ID NO: 440 - protein, 15 aa, Blattella germanica
TLNAMPEYQNLLEKL

SEQ ID NO: 441 - protein, 15 aa, Blattella germanica
PEYQNLLEKLREKGV

SEQ ID NO: 442 - protein, 15 aa, Blattella germanica
LLEKLREKGVDVDKI

SEQ ID NO: 443 - protein, 15 aa, Blattella germanica
REKGVDVDKIIELIR

SEQ ID NO: 444 - protein, 15 aa, Blattella germanica
DVDKIIELIRALFGL

SEQ ID NO: 445 - protein, 15 aa, Blattella germanica
DKIIELIRALFGLTH

SEQ ID NO: 446 - protein, 15 aa, Blattella germanica
SQKDPHVWDGRSAIV

SEQ ID NO: 447 - protein, 15 aa, Blattella germanica
HLFEWKFADIADECE

SEQ ID NO: 448 - protein, 15 aa, Blattella germanica
KFADIADECERFLGP

SEQ ID NO: 449 - protein, 15 aa, Blattella germanica
ADECERFLGPKGFAG

SEQ ID NO: 450 - protein, 15 aa, Blattella germanica
RFLGPKGFAGVQVSP

SEQ ID NO: 451 - protein, 15 aa, Blattella germanica
VQVSPVHENVIISSP

SEQ ID NO: 452 - protein, 15 aa, Blattella germanica
IISSPFRPWWERYQL

SEQ ID NO: 453 - protein, 15 aa, Blattella germanica
VSYKLVSRSGDENAF

SEQ ID NO: 454 - protein, 15 aa, Blattella germanica
VSRSGDENAFRDMVR

SEQ ID NO: 455 - protein, 15 aa, Blattella germanica
DENAFRDMVRRCNNV

SEQ ID NO: 456 - protein, 15 aa, Blattella germanica
NQMSGSWPDAHGQGG

SEQ ID NO: 457 - protein, 15 aa, Blattella germanica
SWPDAHGQGGSTADT

SEQ ID NO: 458 - protein, 15 aa, Blattella germanica
HGQGGSTADTYNLQY

SEQ ID NO: 459 - protein, 15 aa, Blattella germanica
STADTYNLQYPAVPY

SEQ ID NO: 460 - protein, 15 aa, Blattella germanica
YNLQYPAVPYGPGDF

SEQ ID NO: 461 - protein, 15 aa, Blattella germanica
PAVPYGPGDFHSTCT

SEQ ID NO: 462 - protein, 15 aa, Blattella germanica
GPGDFHSTCTVSNYQ

SEQ ID NO: 463 - protein, 15 aa, Blattella germanica
HSTCTVSNYQDPSNV

SEQ ID NO: 464 - protein, 15 aa, Blattella germanica
VSNYQDPSNVRNCEL

SEQ ID NO: 465 - protein, 15 aa, Blattella germanica
DPSNVRNCELVGLHD

SEQ ID NO: 466 - protein, 15 aa, Blattella germanica
RNCELVGLHDLNQGS

SEQ ID NO: 467 - protein, 15 aa, Blattella germanica
VGLHDLNQGSDYVRG

SEQ ID NO: 468 - protein, 15 aa, Blattella germanica
LNHLVDCGVAGFRVD

SEQ ID NO: 469 - protein, 15 aa, Blattella germanica
AAKHMWPADLQYIYS

SEQ ID NO: 470 - protein, 15 aa, Blattella germanica
WPADLQYIYSKVNNL

SEQ ID NO: 471 - protein, 15 aa, Blattella germanica
QYIYSKVNNLNTDHG

SEQ ID NO: 472 - protein, 15 aa, Blattella germanica
KVNNLNTDHGFPSGA

SEQ ID NO: 473 - protein, 15 aa, Blattella germanica
NTDHGFPSGARPFFY

SEQ ID NO: 474 - protein, 15 aa, Blattella germanica
FPSGARPFFYQEVID

SEQ ID NO: 475 - protein, 15 aa, Blattella germanica
RPFFYQEVIDLGGEA

SEQ ID NO: 476 - protein, 15 aa, Blattella germanica
QEVIDLGGEAIHSTE

SEQ ID NO: 477 - protein, 15 aa, Blattella germanica
LGGEAIHSTEYTGFG

SEQ ID NO: 478 - protein, 15 aa, Blattella germanica
IHSTEYTGFGRVTEF

SEQ ID NO: 479 - protein, 15 aa, Blattella germanica
YTGFGRVTEFKYSRD

SEQ ID NO: 480 - protein, 15 aa, Blattella germanica
RVTEFKYSRDIGDAF

SEQ ID NO: 481 - protein, 15 aa, Blattella germanica
KYSRDIGDAFRGNNA

SEQ ID NO: 482 - protein, 15 aa, Blattella germanica
IGDAFRGNNAIKWLV

SEQ ID NO: 483 - protein, 15 aa, Blattella germanica
RGNNAIKWLVNFGVG

SEQ ID NO: 484 - protein, 15 aa, Blattella germanica
IKWLVNFGVGWGYIP

SEQ ID NO: 485 - protein, 15 aa, Blattella germanica
NFGVGWGYIPDGDAL

SEQ ID NO: 486 - protein, 15 aa, Blattella germanica
WGYIPDGDALVFVDN

SEQ ID NO: 487 - protein, 15 aa, Blattella germanica
DGDALVFVDNHDNQR

SEQ ID NO: 488 - protein, 15 aa, Blattella germanica
VFVDNHDNQRGHGAG

SEQ ID NO: 489 - protein, 15 aa, Blattella germanica
HDNQRGHGAGGASIL

SEQ ID NO: 490 - protein, 15 aa, Blattella germanica
GHGAGGASILTYKTS

SEQ ID NO: 491 - protein, 15 aa, Blattella germanica
GASILTYKTSKLYKM

SEQ ID NO: 492 - protein, 15 aa, Blattella germanica
TYKTSKLYKMAVAFM

SEQ ID NO: 493 - protein, 15 aa, Blattella germanica
KLYKMAVAFMLAYPY

SEQ ID NO: 494 - protein, 15 aa, Blattella germanica
AVAFMLAYPYGYPRV

SEQ ID NO: 495 - protein, 15 aa, Blattella germanica
LAYPYGYPRVMSSFS

SEQ ID NO: 496 - protein, 15 aa, Blattella germanica
GYPRVMSSFSFDNSD

SEQ ID NO: 497 - protein, 15 aa, Blattella germanica
MSSFSFDNSDQGPPQ

SEQ ID NO: 498 - protein, 15 aa, Blattella germanica
FDNSDQGPPQDGNGN

SEQ ID NO: 499 - protein, 15 aa, Blattella germanica
QGPPQDGNGNIISPS

SEQ ID NO: 500 - protein, 15 aa, Blattella germanica
DGNGNIISPSINADG

SEQ ID NO: 501 - protein, 15 aa, Blattella germanica
IISPSINADGTCGNG

SEQ ID NO: 502 - protein, 15 aa, Blattella germanica
INADGTCGNGWVCEH

SEQ ID NO: 503 - protein, 15 aa, Blattella germanica
TCGNGWVCEHRWRQI

SEQ ID NO: 504 - protein, 15 aa, Blattella germanica
WVCEHRWRQIFNMVG

SEQ ID NO: 505 - protein, 15 aa, Blattella germanica
RWRQIFNMVGFRNAV

SEQ ID NO: 506 - protein, 15 aa, Blattella germanica
FNMVGFRNAVAGTAV

SEQ ID NO: 507 - protein, 15 aa, Blattella germanica
FRNAVAGTAVSNWWD

SEQ ID NO: 508 - protein, 15 aa, Blattella germanica
AGTAVSNWWDNGDKQ

SEQ ID NO: 509 - protein, 15 aa, Blattella germanica
SNWWDNGDKQISFCR

SEQ ID NO: 510 - protein, 15 aa, Blattella germanica
NGDKQISFCRGNKGF

SEQ ID NO: 511 - protein, 15 aa, Blattella germanica
ISFCRGNKGFVAFND

SEQ ID NO: 512 - protein, 15 aa, Blattella germanica
GNKGFVAFNDEFNND

SEQ ID NO: 513 - protein, 15 aa, Blattella germanica
VAFNDEFNNDLKQTL

SEQ ID NO: 514 - protein, 15 aa, Blattella germanica
EFNNDLKQTLQTCLP

SEQ ID NO: 515 - protein, 15 aa, Blattella germanica
LKQTLQTCLPAGDYC

SEQ ID NO: 516 - protein, 15 aa, Blattella germanica
QTCLPAGDYCDVISG

SEQ ID NO: 517 - protein, 15 aa, Blattella germanica
AGDYCDVISGSYENG

SEQ ID NO: 518 - protein, 15 aa, Blattella germanica
DVISGSYENGSCTGK

SEQ ID NO: 519 - protein, 15 aa, Blattella germanica
SYENGSCTGKTVTVG

SEQ ID NO: 520 - protein, 15 aa, Blattella germanica
SCTGKTVTVGSDGKA

SEQ ID NO: 521 - protein, 15 aa, Blattella germanica
TVTVGSDGKAYIEIL

SEQ ID NO: 522 - protein, 15 aa, Blattella germanica
SDGKAYIEILSSADD

SEQ ID NO: 523 - protein, 15 aa, Blattella germanica
YIEILSSADDGVLAI

SEQ ID NO: 524 - protein, 15 aa, Blattella germanica
SSADDGVLAIHVNSK

SEQ ID NO: 525 - protein, 15 aa, Blattella germanica
GVLAIHVNSKVGSKS

SEQ ID NO: 526 - protein, 15 aa, Blattella germanica
HVNSKVGSKSQTTTT

SEQ ID NO: 527 - protein, 15 aa, Blattella germanica
VGSKSQTTTTQSSHC

SEQ ID NO: 528 - protein, 15 aa, Blattella germanica
KSQTTTTQSSHCTCS

SEQ ID NO: 529 - protein, 15 aa, Blattella germanica
MIGLKLVTVLFAVAT

SEQ ID NO: 530 - protein, 15 aa, Blattella germanica
LVTVLFAVATITHAA

SEQ ID NO: 531 - protein, 15 aa, Blattella germanica
FAVATITHAAELQRV

SEQ ID NO: 532 - protein, 15 aa, Blattella germanica
ITHAAELQRVPLYKL

SEQ ID NO: 533 - protein, 15 aa, Blattella germanica
ELQRVPLYKLVHVFI

SEQ ID NO: 534 - protein, 15 aa, Blattella germanica
PLYKLVHVFINTQYA

SEQ ID NO: 535 - protein, 15 aa, Blattella germanica
VHVFINTQYAGITKI

SEQ ID NO: 536 - protein, 15 aa, Blattella germanica
NTQYAGITKIGNQNF

SEQ ID NO: 537 - protein, 15 aa, Blattella germanica
GITKIGNQNFLTVFD

SEQ ID NO: 538 - protein, 15 aa, Blattella germanica
GNQNFLTVFDSTSCN

SEQ ID NO: 539 - protein, 15 aa, Blattella germanica
LTVFDSTSCNVVVAS

SEQ ID NO: 540 - protein, 15 aa, Blattella germanica
STSCNVVVASQECVG

SEQ ID NO: 541 - protein, 15 aa, Blattella germanica
VVVASQECVGGACVC

SEQ ID NO: 542 - protein, 15 aa, Blattella germanica
QECVGGACVCPNLQK

SEQ ID NO: 543 - protein, 15 aa, Blattella germanica
GACVCPNLQKYEKLK

SEQ ID NO: 544 - protein, 15 aa, Blattella germanica
PNLQKYEKLKPKYIS

SEQ ID NO: 545 - protein, 15 aa, Blattella germanica
YEKLKPKYISDGNVQ

SEQ ID NO: 546 - protein, 15 aa, Blattella germanica
PKYISDGNVQVKFFD

SEQ ID NO: 547 - protein, 15 aa, Blattella germanica
DGNVQVKFFDTGSAV

SEQ ID NO: 548 - protein, 15 aa, Blattella germanica
VKFFDTGSAVGRGIE

SEQ ID NO: 549 - protein, 15 aa, Blattella germanica
TGSAVGRGIEDSLTI

SEQ ID NO: 550 - protein, 15 aa, Blattella germanica
GRGIEDSLTISNLTT

SEQ ID NO: 551 - protein, 15 aa, Blattella germanica
DSLTISNLTTSQQDI

SEQ ID NO: 552 - protein, 15 aa, Blattella germanica
SNLTTSQQDIVLADE

SEQ ID NO: 553 - protein, 15 aa, Blattella germanica
SQQDIVLADELSQEV

SEQ ID NO: 554 - protein, 15 aa, Blattella germanica
VLADELSQEVCILSA

SEQ ID NO: 555 - protein, 15 aa, Blattella germanica
LSQEVCILSADVVVG

SEQ ID NO: 556 - protein, 15 aa, Blattella germanica
CILSADVVVGIAAPG

SEQ ID NO: 557 - protein, 15 aa, Blattella germanica
DVVVGIAAPGCPNAL

SEQ ID NO: 558 - protein, 15 aa, Blattella germanica
IAAPGCPNALKGKTV

SEQ ID NO: 559 - protein, 15 aa, Blattella germanica
CPNALKGKTVLENFV

SEQ ID NO: 560 - protein, 15 aa, Blattella germanica
KGKTVLENFVEENLI

SEQ ID NO: 561 - protein, 15 aa, Blattella germanica
LENFVEENLIAPVFS

SEQ ID NO: 562 - protein, 15 aa, Blattella germanica
EENLIAPVFSIHHAR

SEQ ID NO: 563 - protein, 15 aa, Blattella germanica
APVFSIHHARFQDGE

SEQ ID NO: 564 - protein, 15 aa, Blattella germanica
IHHARFQDGEHFGEI

SEQ ID NO: 565 - protein, 15 aa, Blattella germanica
FQDGEHFGEIIFGGS

SEQ ID NO: 566 - protein, 15 aa, Blattella germanica
HFGEIIFGGSDWKYV

SEQ ID NO: 567 - protein, 15 aa, Blattella germanica
IFGGSDWKYVDGEFT

SEQ ID NO: 568 - protein, 15 aa, Blattella germanica
DWKYVDGEFTYVPLV

SEQ ID NO: 569 - protein, 15 aa, Blattella germanica
DGEFTYVPLVGDDSW

SEQ ID NO: 570 - protein, 15 aa, Blattella germanica
YVPLVGDDSWKFRLD

SEQ ID NO: 571 - protein, 15 aa, Blattella germanica
GDDSWKFRLDGVKIG

SEQ ID NO: 572 - protein, 15 aa, Blattella germanica
KFRLDGVKIGDTTVA

SEQ ID NO: 573 - protein, 15 aa, Blattella germanica
GVKIGDTTVAPAGTQ

SEQ ID NO: 574 - protein, 15 aa, Blattella germanica
DTTVAPAGTQAIIDT

SEQ ID NO: 575 - protein, 15 aa, Blattella germanica
PAGTQAIIDTSKAII

SEQ ID NO: 576 - protein, 15 aa, Blattella germanica
AIIDTSKAIIVGPKA

SEQ ID NO: 577 - protein, 15 aa, Blattella germanica
SKAIIVGPKAYVNPI

SEQ ID NO: 578 - protein, 15 aa, Blattella germanica
VGPKAYVNPINEAIG

SEQ ID NO: 579 - protein, 15 aa, Blattella germanica
YVNPINEAIGCVVEK

SEQ ID NO: 580 - protein, 15 aa, Blattella germanica
NEAIGCVVEKTTTRR

SEQ ID NO: 581 - protein, 15 aa, Blattella germanica
CVVEKTTTRRICKLD

SEQ ID NO: 582 - protein, 15 aa, Blattella germanica
TTTRRICKLDCSKIP

SEQ ID NO: 583 - protein, 15 aa, Blattella germanica
ICKLDCSKIPSLPDV

SEQ ID NO: 584 - protein, 15 aa, Blattella germanica
CSKIPSLPDVTFVIN

SEQ ID NO: 585 - protein, 15 aa, Blattella germanica
SLPDVTFVINGRNFN

SEQ ID NO: 586 - protein, 15 aa, Blattella germanica
TFVINGRNFNISSQY

SEQ ID NO: 587 - protein, 15 aa, Blattella germanica
GRNFNISSQYYIQQN

SEQ ID NO: 588 - protein, 15 aa, Blattella germanica
ISSQYYIQQNGNLCY

SEQ ID NO: 589 - protein, 15 aa, Blattella germanica
YIQQNGNLCYSGFQP

SEQ ID NO: 590 - protein, 15 aa, Blattella germanica
GNLCYSGFQPCGHSD

SEQ ID NO: 591 - protein, 15 aa, Blattella germanica
SGFQPCGHSDHFFIG

SEQ ID NO: 592 - protein, 15 aa, Blattella germanica
CGHSDHFFIGDFFVD

SEQ ID NO: 593 - protein, 15 aa, Blattella germanica
HFFIGDFFVDHYYSE

SEQ ID NO: 594 - protein, 15 aa, Blattella germanica
DFFVDHYYSEFNWEN

SEQ ID NO: 595 - protein, 15 aa, Blattella germanica
HYYSEFNWENKTMGF

SEQ ID NO: 596 - protein, 15 aa, Blattella germanica
FNWENKTMGFGRSVE

SEQ ID NO: 597 - protein, 15 aa, Blattella germanica
WENKTMGFGRSVESV

SEQ ID NO: 598 - protein, 15 aa, Blattella germanica
AVLALCATDTLANED

SEQ ID NO: 599 - protein, 15 aa, Blattella germanica
CATDTLANEDCFRHE

SEQ ID NO: 600 - protein, 15 aa, Blattella germanica
LANEDCFRHESLVPN

SEQ ID NO: 601 - protein, 15 aa, Blattella germanica
CFRHESLVPNLDYER

SEQ ID NO: 602 - protein, 15 aa, Blattella germanica
SLVPNLDYERFRGSW

SEQ ID NO: 603 - protein, 15 aa, Blattella germanica
LDYERFRGSWIIAAG

SEQ ID NO: 604 - protein, 15 aa, Blattella germanica
FRGSWIIAAGTSEAL

SEQ ID NO: 605 - protein, 15 aa, Blattella germanica
IIAAGTSEALTQYKC

SEQ ID NO: 606 - protein, 15 aa, Blattella germanica
TSEALTQYKCWIDRF

SEQ ID NO: 607 - protein, 15 aa, Blattella germanica
TQYKCWIDRFSYDDA

SEQ ID NO: 608 - protein, 15 aa, Blattella germanica
WIDRFSYDDALVSKY

SEQ ID NO: 609 - protein, 15 aa, Blattella germanica
SYDDALVSKYTDSQG

SEQ ID NO: 610 - protein, 15 aa, Blattella germanica
LVSKYTDSQGKNRTT

SEQ ID NO: 611 - protein, 15 aa, Blattella germanica
TDSQGKNRTTIRGRT

SEQ ID NO: 612 - protein, 15 aa, Blattella germanica
KNRTTIRGRTKFEGN

SEQ ID NO: 613 - protein, 15 aa, Blattella germanica
IRGRTKFEGNKFTID

SEQ ID NO: 614 - protein, 15 aa, Blattella germanica
KFEGNKFTIDYNDKG

SEQ ID NO: 615 - protein, 15 aa, Blattella germanica
KFTIDYNDKGKAFSA

SEQ ID NO: 616 - protein, 15 aa, Blattella germanica
YNDKGKAFSAPYSVL

SEQ ID NO: 617 - protein, 15 aa, Blattella germanica
KAFSAPYSVLATDYE

SEQ ID NO: 618 - protein, 15 aa, Blattella germanica
PYSVLATDYENYAIV

SEQ ID NO: 619 - protein, 15 aa, Blattella germanica
ATDYENYAIVEGCPA

SEQ ID NO: 620 - protein, 15 aa, Blattella germanica
NYAIVEGCPAAANGH

SEQ ID NO: 621 - protein, 15 aa, Blattella germanica
EGCPAAANGHVIYVQ

SEQ ID NO: 622 - protein, 15 aa, Blattella germanica
AANGHVIYVQIRFSV

SEQ ID NO: 623 - protein, 15 aa, Blattella germanica
VIYVQIRFSVRRFHP

SEQ ID NO: 624 - protein, 15 aa, Blattella germanica
IRFSVRRFHPKLGDK

SEQ ID NO: 625 - protein, 15 aa, Blattella germanica
RRFHPKLGDKEMIQH

SEQ ID NO: 626 - protein, 15 aa, Blattella germanica
KLGDKEMIQHYTLDQ

SEQ ID NO: 627 - protein, 15 aa, Blattella germanica
EMIQHYTLDQVNQHK

SEQ ID NO: 628 - protein, 15 aa, Blattella germanica
YTLDQVNQHKKAIEE

SEQ ID NO: 629 - protein, 15 aa, Blattella germanica
VNQHKKAIEEDLKHF

SEQ ID NO: 630 - protein, 15 aa, Blattella germanica
KAIEEDLKHFNLKYE

SEQ ID NO: 631 - protein, 15 aa, Blattella germanica
DLKHFNLKYEDLHST

SEQ ID NO: 632 - protein, 15 aa, Blattella germanica
KHFNLKYEDLHSTCH

SEQ ID NO: 633 - protein, 15 aa, Blattella germanica
MAPSYKLTYCPVKAL

SEQ ID NO: 634 - protein, 15 aa, Blattella germanica
KLTYCPVKALGEPIR

SEQ ID NO: 635 - protein, 15 aa, Blattella germanica
PVKALGEPIRFLLSY

SEQ ID NO: 636 - protein, 15 aa, Blattella germanica
GEPIRFLLSYGEKDF

SEQ ID NO: 637 - protein, 15 aa, Blattella germanica
FLLSYGEKDFEDYRF

SEQ ID NO: 638 - protein, 15 aa, Blattella germanica
GEKDFEDYRFQEGDW

SEQ ID NO: 639 - protein, 15 aa, Blattella germanica
EDYRFQEGDWPNLKP

SEQ ID NO: 640 - protein, 15 aa, Blattella germanica
QEGDWPNLKPSMPFG

SEQ ID NO: 641 - protein, 15 aa, Blattella germanica
PNLKPSMPFGKTPVL

SEQ ID NO: 642 - protein, 15 aa, Blattella germanica
SMPFGKTPVLEIDGK

SEQ ID NO: 643 - protein, 15 aa, Blattella germanica
KTPVLEIDGKQTHQS

SEQ ID NO: 644 - protein, 15 aa, Blattella germanica
EIDGKQTHQSVAISR

SEQ ID NO: 645 - protein, 15 aa, Blattella germanica
QTHQSVAISRYLGKQ

SEQ ID NO: 646 - protein, 15 aa, Blattella germanica
VAISRYLGKQFGLSG

SEQ ID NO: 647 - protein, 15 aa, Blattella germanica
YLGKQFGLSGKDDWE

SEQ ID NO: 648 - protein, 15 aa, Blattella germanica
FGLSGKDDWENLEID

SEQ ID NO: 649 - protein, 15 aa, Blattella germanica
KDDWENLEIDMIVDT

SEQ ID NO: 650 - protein, 15 aa, Blattella germanica
NLEIDMIVDTISDFR

SEQ ID NO: 651 - protein, 15 aa, Blattella germanica
MIVDTISDFRAAIAN

SEQ ID NO: 652 - protein, 15 aa, Blattella germanica
ISDFRAAIANYHYDA

SEQ ID NO: 653 - protein, 15 aa, Blattella germanica
AAIANYHYDADENSK

SEQ ID NO: 654 - protein, 15 aa, Blattella germanica
YHYDADENSKQKKWD

SEQ ID NO: 655 - protein, 15 aa, Blattella germanica
DENSKQKKWDPLKKE

SEQ ID NO: 656 - protein, 15 aa, Blattella germanica
QKKWDPLKKETIPYY

SEQ ID NO: 657 - protein, 15 aa, Blattella germanica
PLKKETIPYYTKKFD

SEQ ID NO: 658 - protein, 15 aa, Blattella germanica
TIPYYTKKFDEVVKA

SEQ ID NO: 659 - protein, 15 aa, Blattella germanica
TKKFDEVVKANGGYL

SEQ ID NO: 660 - protein, 15 aa, Blattella germanica
EVVKANGGYLAAGKL

SEQ ID NO: 661 - protein, 15 aa, Blattella germanica
NGGYLAAGKLTWADF

SEQ ID NO: 662 - protein, 15 aa, Blattella germanica
AAGKLTWADFYFVAI

SEQ ID NO: 663 - protein, 15 aa, Blattella germanica
TWADFYFVAILDYLN

SEQ ID NO: 664 - protein, 15 aa, Blattella germanica
YFVAILDYLNHMAKE

SEQ ID NO: 665 - protein, 15 aa, Blattella germanica
LDYLNHMAKEDLVAN

SEQ ID NO: 666 - protein, 15 aa, Blattella germanica
HMAKEDLVANQPNLK

SEQ ID NO: 667 - protein, 15 aa, Blattella germanica
DLVANQPNLKALREK

SEQ ID NO: 668 - protein, 15 aa, Blattella germanica
QPNLKALREKVLGLP

SEQ ID NO: 669 - protein, 15 aa, Blattella germanica
ALREKVLGLPAIKAW

SEQ ID NO: 670 - protein, 15 aa, Blattella germanica
VLGLPAIKAWVAKRP

SEQ ID NO: 671 - protein, 15 aa, Blattella germanica
PAIKAWVAKRPPTDL

SEQ ID NO: 672 - protein, 15 aa, Blattella germanica
MADEQLQLPPEQISV

SEQ ID NO: 673 - protein, 15 aa, Blattella germanica
LQLPPEQISVLRKAF

SEQ ID NO: 674 - protein, 15 aa, Blattella germanica
EQISVLRKAFDAFDR

SEQ ID NO: 675 - protein, 15 aa, Blattella germanica
LRKAFDAFDREKSGS

SEQ ID NO: 676 - protein, 15 aa, Blattella germanica
DAFDREKSGSISTNM

SEQ ID NO: 677 - protein, 15 aa, Blattella germanica
EKSGSISTNMVEEIL

SEQ ID NO: 678 - protein, 15 aa, Blattella germanica
ISTNMVEEILRLMGQ

SEQ ID NO: 679 - protein, 15 aa, Blattella germanica
VEEILRLMGQPFNRR

SEQ ID NO: 680 - protein, 15 aa, Blattella germanica
RLMGQPFNRRTLEEL

SEQ ID NO: 681 - protein, 15 aa, Blattella germanica
PFNRRTLEELIDEVD

SEQ ID NO: 682 - protein, 15 aa, Blattella germanica
TLEELIDEVDADKSG

SEQ ID NO: 683 - protein, 15 aa, Blattella germanica
IDEVDADKSGRLEFD

SEQ ID NO: 684 - protein, 15 aa, Blattella germanica
ADKSGRLEFDEFVTL

SEQ ID NO: 685 - protein, 15 aa, Blattella germanica
RLEFDEFVTLAAKFI

SEQ ID NO: 686 - protein, 15 aa, Blattella germanica
EFVTLAAKFIIEEDS

SEQ ID NO: 687 - protein, 15 aa, Blattella germanica
AAKFIIEEDSEAMEK

SEQ ID NO: 688 - protein, 15 aa, Blattella germanica
IEEDSEAMEKELREA

SEQ ID NO: 689 - protein, 15 aa, Blattella germanica
EAMEKELREAFRLYD

SEQ ID NO: 690 - protein, 15 aa, Blattella germanica
ELREAFRLYDKEGNG

SEQ ID NO: 691 - protein, 15 aa, Blattella germanica
FRLYDKEGNGYIPTS

SEQ ID NO: 692 - protein, 15 aa, Blattella germanica
KEGNGYIPTSCLREI

SEQ ID NO: 693 - protein, 15 aa, Blattella germanica
YIPTSCLREILRELD

SEQ ID NO: 694 - protein, 15 aa, Blattella germanica
CLREILRELDEQLTS

SEQ ID NO: 695 - protein, 15 aa, Blattella germanica
LRELDEQLTSDELDM

SEQ ID NO: 696 - protein, 15 aa, Blattella germanica
EQLTSDELDMMIEEI

SEQ ID NO: 697 - protein, 15 aa, Blattella germanica
DELDMMIEEIDADGS

SEQ ID NO: 698 - protein, 15 aa, Blattella germanica
MIEEIDADGSGTVDF

SEQ ID NO: 699 - protein, 15 aa, Blattella germanica
DADGSGTVDFDEFME

SEQ ID NO: 700 - protein, 15 aa, Blattella germanica
SGTVDFDEFMEMMTG

SEQ ID NO: 701 - protein, 15 aa, Blattella germanica
MDEIPAEQVVLLKKA

SEQ ID NO: 702 - protein, 15 aa, Blattella germanica
DEIPAEQVVLLKKAF

SEQ ID NO: 703 - protein, 15 aa, Blattella germanica
EQVVLLKKAFDAFDR

SEQ ID NO: 704 - protein, 15 aa, Blattella germanica
LKKAFDAFDREKKGC

SEQ ID NO: 705 - protein, 15 aa, Blattella germanica
DAFDREKKGCISTEM

SEQ ID NO: 706 - protein, 15 aa, Blattella germanica
EKKGCISTEMVGTIL

SEQ ID NO: 707 - protein, 15 aa, Blattella germanica
ISTEMVGTILEMLGT

SEQ ID NO: 708 - protein, 15 aa, Blattella germanica
VGTILEMLGTRLDQD

SEQ ID NO: 709 - protein, 15 aa, Blattella germanica
EMLGTRLDQDMLDEI

SEQ ID NO: 710 - protein, 15 aa, Blattella germanica
RLDQDMLDEIIAEVD

SEQ ID NO: 711 - protein, 15 aa, Blattella germanica
MLDEIIAEVDADGSG

SEQ ID NO: 712 - protein, 15 aa, Blattella germanica
IAEVDADGSGELEFE

SEQ ID NO: 713 - protein, 15 aa, Blattella germanica
ADGSGELEFEEFCTL

SEQ ID NO: 714 - protein, 15 aa, Blattella germanica
ELEFEEFCTLASRFL

SEQ ID NO: 715 - protein, 15 aa, Blattella germanica
EFCTLASRFLVEEDA

SEQ ID NO: 716 - protein, 15 aa, Blattella germanica
ASRFLVEEDAEAMQH

SEQ ID NO: 717 - protein, 15 aa, Blattella germanica
VEEDAEAMQHELREA

SEQ ID NO: 718 - protein, 15 aa, Blattella germanica
EAMQHELREAFRLYD

SEQ ID NO: 719 - protein, 15 aa, Blattella germanica
ELREAFRLYDKEGNG

SEQ ID NO: 720 - protein, 15 aa, Blattella germanica
FRLYDKEGNGYITTA

SEQ ID NO: 721 - protein, 15 aa, Blattella germanica
KEGNGYITTAVLREI

SEQ ID NO: 722 - protein, 15 aa, Blattella germanica
YITTAVLREILKELD

SEQ ID NO: 723 - protein, 15 aa, Blattella germanica
VLREILKELDDKITA

SEQ ID NO: 724 - protein, 15 aa, Blattella germanica
LKELDDKITAEDLDM

SEQ ID NO: 725 - protein, 15 aa, Blattella germanica
DKITAEDLDMMIEEI

SEQ ID NO: 726 - protein, 15 aa, Blattella germanica
EDLDMMIEEIDSDGS

SEQ ID NO: 727 - protein, 15 aa, Blattella germanica
MIEEIDSDGSGTVDF

SEQ ID NO: 728 - protein, 15 aa, Blattella germanica
DSDGSGTVDFDEFME

SEQ ID NO: 729 - protein, 15 aa, Blattella germanica
SGTVDFDEFMEVMTG

SEQ ID NO: 730 - protein, 15 aa, Blattella germanica
GTVDFDEFMEVMTGE

SEQ ID NO: 731 - protein, 15 aa, Blattella germanica
MDELPPEQIQLLKKA

SEQ ID NO: 732 - protein, 15 aa, Blattella germanica
DELPPEQIQLLKKAF

SEQ ID NO: 733 - protein, 15 aa, Blattella germanica
EQIQLLKKAFDAFDR

SEQ ID NO: 734 - protein, 15 aa, Blattella germanica
ISTEMVGTILEMLGH

SEQ ID NO: 735 - protein, 15 aa, Blattella germanica
VGTILEMLGHRLDDD

SEQ ID NO: 736 - protein, 15 aa, Blattella germanica
EMLGHRLDDDMLQEI

SEQ ID NO: 737 - protein, 15 aa, Blattella germanica
RLDDDMLQEIIAEVD

SEQ ID NO: 738 - protein, 15 aa, Blattella germanica
MLQEIIAEVDADGSG

SEQ ID NO: 739 - protein, 15 aa, Blattella germanica
ADGSGELEFEEFVSL

SEQ ID NO: 740 - protein, 15 aa, Blattella germanica
ELEFEEFVSLASRFL

SEQ ID NO: 741 - protein, 15 aa, Blattella germanica
EFVSLASRFLVEEDA

SEQ ID NO: 742 - protein, 15 aa, Blattella germanica
ASRFLVEEDAEAMQQ

SEQ ID NO: 743 - protein, 15 aa, Blattella germanica
VEEDAEAMQQELREA

SEQ ID NO: 744 - protein, 15 aa, Blattella germanica
EAMQQELREAFRLYD

SEQ ID NO: 745 - protein, 15 aa, Blattella germanica
FRLYDKEGNGYITTN

SEQ ID NO: 746 - protein, 15 aa, Blattella germanica
KEGNGYITTNVLREI

SEQ ID NO: 747 - protein, 15 aa, Blattella germanica
YITTNVLREILKELD

SEQ ID NO: 748 - protein, 15 aa, Blattella germanica
MDAIKKKMQAMKLEK

SEQ ID NO: 749 - protein, 15 aa, Blattella germanica
KKMQAMKLEKDNAMD

SEQ ID NO: 750 - protein, 15 aa, Blattella germanica
MKLEKDNAMDRALLC

SEQ ID NO: 751 - protein, 15 aa, Blattella germanica
DNAMDRALLCEQQAR

SEQ ID NO: 752 - protein, 15 aa, Blattella germanica
RALLCEQQARDANIR

SEQ ID NO: 753 - protein, 15 aa, Blattella germanica
EQQARDANIRAEKAE

SEQ ID NO: 754 - protein, 15 aa, Blattella germanica
DANIRAEKAEEEARS

SEQ ID NO: 755 - protein, 15 aa, Blattella germanica
AEKAEEEARSLQKKI

SEQ ID NO: 756 - protein, 15 aa, Blattella germanica
EEARSLQKKIQQIEN

SEQ ID NO: 757 - protein, 15 aa, Blattella germanica
LQKKIQQIENDLDQT

SEQ ID NO: 758 - protein, 15 aa, Blattella germanica
QQIENDLDQTMEQLM

SEQ ID NO: 759 - protein, 15 aa, Blattella germanica
DLDQTMEQLMQVNAK

SEQ ID NO: 760 - protein, 15 aa, Blattella germanica
MEQLMQVNAKLDEKD

SEQ ID NO: 761 - protein, 15 aa, Blattella germanica
QVNAKLDEKDKALQN

SEQ ID NO: 762 - protein, 15 aa, Blattella germanica
LDEKDKALQNAESEV

SEQ ID NO: 763 - protein, 15 aa, Blattella germanica
KALQNAESEVAALNR

SEQ ID NO: 764 - protein, 15 aa, Blattella germanica
AESEVAALNRRIQLL

SEQ ID NO: 765 - protein, 15 aa, Blattella germanica
AALNRRIQLLEEDLE

SEQ ID NO: 766 - protein, 15 aa, Blattella germanica
RIQLLEEDLERSEER

SEQ ID NO: 767 - protein, 15 aa, Blattella germanica
EEDLERSEERLATAT

SEQ ID NO: 768 - protein, 15 aa, Blattella germanica
RSEERLATATAKLAE

SEQ ID NO: 769 - protein, 15 aa, Blattella germanica
LATATAKLAEASQAA

SEQ ID NO: 770 - protein, 15 aa, Blattella germanica
AKLAEASQAADESER

SEQ ID NO: 771 - protein, 15 aa, Blattella germanica
ASQAADESERARKIL

SEQ ID NO: 772 - protein, 15 aa, Blattella germanica
DESERARKILESKGL

SEQ ID NO: 773 - protein, 15 aa, Blattella germanica
ARKILESKGLADEER

SEQ ID NO: 774 - protein, 15 aa, Blattella germanica
ESKGLADEERMDALE

SEQ ID NO: 775 - protein, 15 aa, Blattella germanica
ADEERMDALENQLKE

SEQ ID NO: 776 - protein, 15 aa, Blattella germanica
MDALENQLKEARFMA

SEQ ID NO: 777 - protein, 15 aa, Blattella germanica
NQLKEARFMAEEADK

SEQ ID NO: 778 - protein, 15 aa, Blattella germanica
ARFMAEEADKKYDEV

SEQ ID NO: 779 - protein, 15 aa, Blattella germanica
EEADKKYDEVARKLA

SEQ ID NO: 780 - protein, 15 aa, Blattella germanica
KYDEVARKLAMVEAD

SEQ ID NO: 781 - protein, 15 aa, Blattella germanica
ARKLAMVEADLERAE

SEQ ID NO: 782 - protein, 15 aa, Blattella germanica
MVEADLERAEERAET

SEQ ID NO: 783 - protein, 15 aa, Blattella germanica
LERAEERAETGESKI

SEQ ID NO: 784 - protein, 15 aa, Blattella germanica
ERAETGESKIVELEE

SEQ ID NO: 785 - protein, 15 aa, Blattella germanica
GESKIVELEEELRVV

SEQ ID NO: 786 - protein, 15 aa, Blattella germanica
VELEEELRVVGNNLK

SEQ ID NO: 787 - protein, 15 aa, Blattella germanica
ELRVVGNNLKSLEVS

SEQ ID NO: 788 - protein, 15 aa, Blattella germanica
GNNLKSLEVSEEKAN

SEQ ID NO: 789 - protein, 15 aa, Blattella germanica
SLEVSEEKANLREEE

SEQ ID NO: 790 - protein, 15 aa, Blattella germanica
EEKANLREEEYKQQI

SEQ ID NO: 791 - protein, 15 aa, Blattella germanica
LREEEYKQQIKTLNT

SEQ ID NO: 792 - protein, 15 aa, Blattella germanica
YKQQIKTLNTRLKEA

SEQ ID NO: 793 - protein, 15 aa, Blattella germanica
KTLNTRLKEAEARAE

SEQ ID NO: 794 - protein, 15 aa, Blattella germanica
RLKEAEARAEFAERS

SEQ ID NO: 795 - protein, 15 aa, Blattella germanica
EARAEFAERSVQKLQ

SEQ ID NO: 796 - protein, 15 aa, Blattella germanica
FAERSVQKLQKEVDR

SEQ ID NO: 797 - protein, 15 aa, Blattella germanica
VQKLQKEVDRLEDEL

SEQ ID NO: 798 - protein, 15 aa, Blattella germanica
KEVDRLEDELVHEKE

SEQ ID NO: 799 - protein, 15 aa, Blattella germanica
LEDELVHEKEKYKYI

SEQ ID NO: 800 - protein, 15 aa, Blattella germanica
VHEKEKYKYICDDLD

SEQ ID NO: 801 - protein, 15 aa, Blattella germanica
KYKYICDDLDMTFTE

SEQ ID NO: 802 - protein, 15 aa, Blattella germanica
ICDDLDMTFTELIGN

SEQ ID NO: 803 - protein, 15 aa, Blattella germanica
MVDAAVLEKLEAGFA

SEQ ID NO: 804 - protein, 15 aa, Blattella germanica
VLEKLEAGFAKLAAS

SEQ ID NO: 805 - protein, 15 aa, Blattella germanica
EAGFAKLAASDSKSL

SEQ ID NO: 806 - protein, 15 aa, Blattella germanica
KLAASDSKSLLRKYL

SEQ ID NO: 807 - protein, 15 aa, Blattella germanica
DSKSLLRKYLTKEVF

SEQ ID NO: 808 - protein, 15 aa, Blattella germanica
LRKYLTKEVFDNLKT

SEQ ID NO: 809 - protein, 15 aa, Blattella germanica
TKEVFDNLKTKKTPT

SEQ ID NO: 810 - protein, 15 aa, Blattella germanica
DNLKTKKTPTFGSTL

SEQ ID NO: 811 - protein, 15 aa, Blattella germanica
KKTPTFGSTLLDVIQ

SEQ ID NO: 812 - protein, 15 aa, Blattella germanica
FGSTLLDVIQSGLEN

SEQ ID NO: 813 - protein, 15 aa, Blattella germanica
LDVIQSGLENHDSGV

SEQ ID NO: 814 - protein, 15 aa, Blattella germanica
SGLENHDSGVGIYAP

SEQ ID NO: 815 - protein, 15 aa, Blattella germanica
HDSGVGIYAPDAEAY

SEQ ID NO: 816 - protein, 15 aa, Blattella germanica
GIYAPDAEAYTVFAD

SEQ ID NO: 817 - protein, 15 aa, Blattella germanica
DAEAYTVFADLFDPI

SEQ ID NO: 818 - protein, 15 aa, Blattella germanica
TVFADLFDPIIEDYH

SEQ ID NO: 819 - protein, 15 aa, Blattella germanica
LFDPIIEDYHGGFKK

SEQ ID NO: 820 - protein, 15 aa, Blattella germanica
IEDYHGGFKKTDKHP

SEQ ID NO: 821 - protein, 15 aa, Blattella germanica
GGFKKTDKHPPKDWG

SEQ ID NO: 822 - protein, 15 aa, Blattella germanica
TDKHPPKDWGDVDTL

SEQ ID NO: 823 - protein, 15 aa, Blattella germanica
PKDWGDVDTLGNLDP

SEQ ID NO: 824 - protein, 15 aa, Blattella germanica
DVDTLGNLDPAGEYI

SEQ ID NO: 825 - protein, 15 aa, Blattella germanica
GNLDPAGEYIISTRV

SEQ ID NO: 826 - protein, 15 aa, Blattella germanica
AGEYIISTRVRCGRS

SEQ ID NO: 827 - protein, 15 aa, Blattella germanica
ISTRVRCGRSMQGYP

SEQ ID NO: 828 - protein, 15 aa, Blattella germanica
RCGRSMQGYPFNPCL

SEQ ID NO: 829 - protein, 15 aa, Blattella germanica
MQGYPFNPCLTEAQY

SEQ ID NO: 830 - protein, 15 aa, Blattella germanica
FNPCLTEAQYKEMED

SEQ ID NO: 831 - protein, 15 aa, Blattella germanica
TEAQYKEMEDKVSST

SEQ ID NO: 832 - protein, 15 aa, Blattella germanica
KEMEDKVSSTLSGLE

SEQ ID NO: 833 - protein, 15 aa, Blattella germanica
KVSSTLSGLEGELKG

SEQ ID NO: 834 - protein, 15 aa, Blattella germanica
LSGLEGELKGQFYPL

SEQ ID NO: 835 - protein, 15 aa, Blattella germanica
GELKGQFYPLTGMTK

SEQ ID NO: 836 - protein, 15 aa, Blattella germanica
QFYPLTGMTKEVQQK

SEQ ID NO: 837 - protein, 15 aa, Blattella germanica
TGMTKEVQQKLIDDH

SEQ ID NO: 838 - protein, 15 aa, Blattella germanica
EVQQKLIDDHFLFKE

SEQ ID NO: 839 - protein, 15 aa, Blattella germanica
LIDDHFLFKEGDRFL

SEQ ID NO: 840 - protein, 15 aa, Blattella germanica
FLFKEGDRFLQHANA

SEQ ID NO: 841 - protein, 15 aa, Blattella germanica
GDRFLQHANACRFWP

SEQ ID NO: 842 - protein, 15 aa, Blattella germanica
QHANACRFWPTGRGI

SEQ ID NO: 843 - protein, 15 aa, Blattella germanica
CRFWPTGRGIYHNDA

SEQ ID NO: 844 - protein, 15 aa, Blattella germanica
TGRGIYHNDAKTFLV

SEQ ID NO: 845 - protein, 15 aa, Blattella germanica
YHNDAKTFLVWCNEE

SEQ ID NO: 846 - protein, 15 aa, Blattella germanica
KTFLVWCNEEDHLRI

SEQ ID NO: 847 - protein, 15 aa, Blattella germanica
WCNEEDHLRIISMQM

SEQ ID NO: 848 - protein, 15 aa, Blattella germanica
DHLRIISMQMGGDLG

SEQ ID NO: 849 - protein, 15 aa, Blattella germanica
ISMQMGGDLGQVYRR

SEQ ID NO: 850 - protein, 15 aa, Blattella germanica
GGDLGQVYRRLVTAV

SEQ ID NO: 851 - protein, 15 aa, Blattella germanica
QVYRRLVTAVNDIEK

SEQ ID NO: 852 - protein, 15 aa, Blattella germanica
LVTAVNDIEKRVPFS

SEQ ID NO: 853 - protein, 15 aa, Blattella germanica
NDIEKRVPFSHDDRL

SEQ ID NO: 854 - protein, 15 aa, Blattella germanica
RVPFSHDDRLGFLTF

SEQ ID NO: 855 - protein, 15 aa, Blattella germanica
HDDRLGFLTFCPTNL

SEQ ID NO: 856 - protein, 15 aa, Blattella germanica
GFLTFCPTNLGTTVR

SEQ ID NO: 857 - protein, 15 aa, Blattella germanica
CPTNLGTTVRASVRI

SEQ ID NO: 858 - protein, 15 aa, Blattella germanica
GTTVRASVRIKVPKL

SEQ ID NO: 859 - protein, 15 aa, Blattella germanica
ASVRIKVPKLAADKK

SEQ ID NO: 860 - protein, 15 aa, Blattella germanica
KVPKLAADKKKLEEV

SEQ ID NO: 861 - protein, 15 aa, Blattella germanica
AADKKKLEEVAGKYN

SEQ ID NO: 862 - protein, 15 aa, Blattella germanica
KLEEVAGKYNLQVRG

SEQ ID NO: 863 - protein, 15 aa, Blattella germanica
AGKYNLQVRGTRGEH

SEQ ID NO: 864 - protein, 15 aa, Blattella germanica
LQVRGTRGEHTEAEG

SEQ ID NO: 865 - protein, 15 aa, Blattella germanica
TRGEHTEAEGGVYDI

SEQ ID NO: 866 - protein, 15 aa, Blattella germanica
TEAEGGVYDISNKRR

SEQ ID NO: 867 - protein, 15 aa, Blattella germanica
GVYDISNKRRMGLTE

SEQ ID NO: 868 - protein, 15 aa, Blattella germanica
SNKRRMGLTEYDAVK

SEQ ID NO: 869 - protein, 15 aa, Blattella germanica
MGLTEYDAVKGMNDG

SEQ ID NO: 870 - protein, 15 aa, Blattella germanica
YDAVKGMNDGIAELI

SEQ ID NO: 871 - protein, 15 aa, Blattella germanica
GMNDGIAELIKIESS

SEQ ID NO: 872 - protein, 15 aa, Blattella germanica
MNDGIAELIKIESSL

SEQ ID NO: 873 - protein, 15 aa, Blattella germanica
MKLFPLVALLVLVVG

SEQ ID NO: 874 - protein, 15 aa, Blattella germanica
LFPLVALLVLVVGVL

SEQ ID NO: 875 - protein, 15 aa, Blattella germanica
ALLVLVVGVLSQKDP

SEQ ID NO: 876 - protein, 15 aa, Blattella germanica
VVGVLSQKDPHVWDG

SEQ ID NO: 877 - protein, 15 aa, Blattella germanica
HVWDGRSAIVHLFEW

SEQ ID NO: 878 - protein, 15 aa, Blattella germanica
RSAIVHLFEWKFADI

SEQ ID NO: 879 - protein, 15 aa, Blattella germanica
KGFAGVQVSPVHENV

SEQ ID NO: 880 - protein, 15 aa, Blattella germanica
VHENVIISSPFRPWW

SEQ ID NO: 881 - protein, 15 aa, Blattella germanica
FRPWWERYQLVSYKL

SEQ ID NO: 882 - protein, 15 aa, Blattella germanica
ERYQLVSYKLVSRSG

SEQ ID NO: 883 - protein, 15 aa, Blattella germanica
RDMVRRCNNVGIRIY

SEQ ID NO: 884 - protein, 15 aa, Blattella germanica
RCNNVGIRIYVDVVL

SEQ ID NO: 885 - protein, 15 aa, Blattella germanica
GIRIYVDVVLNQMSG

SEQ ID NO: 886 - protein, 15 aa, Blattella germanica
VDVVLNQMSGSWPDA

SEQ ID NO: 887 - protein, 15 aa, Blattella germanica
LNQGSDYVRGKMIEY

SEQ ID NO: 888 - protein, 15 aa, Blattella germanica
DYVRGKMIEYLNHLV

SEQ ID NO: 889 - protein, 15 aa, Blattella germanica
KMIEYLNHLVDCGVA

SEQ ID NO: 890 - protein, 15 aa, Blattella germanica
DCGVAGFRVDAAKHM

SEQ ID NO: 891 - protein, 15 aa, Blattella germanica
GFRVDAAKHMWPADL

SEQ ID NO: 892 - protein, 15 aa, Blattella germanica
MKLFPLVALLVLVVG

SEQ ID NO: 893 - protein, 15 aa, Blattella germanica
LFPLVALLVLVVGVL

SEQ ID NO: 894 - protein, 15 aa, Blattella germanica
ALLVLVVGVLSQKDP

SEQ ID NO: 895 - protein, 15 aa, Blattella germanica
VVGVLSQKDPHVWDG

SEQ ID NO: 896 - protein, 15 aa, Blattella germanica
HVWDGRSAIVHLFEW

SEQ ID NO: 897 - protein, 15 aa, Blattella germanica
RSAIVHLFEWKFADI

SEQ ID NO: 898 - protein, 15 aa, Blattella germanica
KGFAGVQVSPVHENV

SEQ ID NO: 899 - protein, 15 aa, Blattella germanica
VHENVIISSPFRPWW

SEQ ID NO: 900 - protein, 15 aa, Blattella germanica
FRPWWERYQLVSYKL

SEQ ID NO: 901 - protein, 15 aa, Blattella germanica
ERYQLVSYKLVSRSG

SEQ ID NO: 902 - protein, 15 aa, Blattella germanica
RDMVRRCNNVGIRIY

SEQ ID NO: 903 - protein, 15 aa, Blattella germanica
RCNNVGIRIYVDVVL

SEQ ID NO: 904 - protein, 15 aa, Blattella germanica
GIRIYVDVVLNQMSG

SEQ ID NO: 905 - protein, 15 aa, Blattella germanica
VDVVLNQMSGSWPDA

SEQ ID NO: 906 - protein, 15 aa, Blattella germanica
LNQGSDYVRGKMIEY

SEQ ID NO: 907 - protein, 15 aa, Blattella germanica
DYVRGKMIEYLNHLV

SEQ ID NO: 908 - protein, 15 aa, Blattella germanica
KMIEYLNHLVDCGVA

SEQ ID NO: 909 - protein, 15 aa, Blattella germanica
DCGVAGFRVDAAKHM

SEQ ID NO: 910 - protein, 15 aa, Blattella germanica
GFRVDAAKHMWPADL

SEQ ID NO: 911 - protein, 15 aa, Blattella germanica
AAKHMWPADLQYIYS

SEQ ID NO: 912 - protein, 15 aa, Blattella germanica
WPADLQYIYSKVNNL

SEQ ID NO: 913 - protein, 15 aa, Blattella germanica
QYIYSKVNNLNTDHG

SEQ ID NO: 914 - protein, 15 aa, Blattella germanica
RPFFYQEVIDLGGEA

SEQ ID NO: 915 - protein, 15 aa, Blattella germanica
IGDAFRGNNAIKWLV

SEQ ID NO: 916 - protein, 15 aa, Blattella germanica
RGNNAIKWLVNFGVG

SEQ ID NO: 917 - protein, 15 aa, Blattella germanica
IKWLVNFGVGWGYIP

SEQ ID NO: 918 - protein, 15 aa, Blattella germanica
GASILTYKTSKLYKM

SEQ ID NO: 919 - protein, 15 aa, Blattella germanica
TYKTSKLYKMAVAFM

SEQ ID NO: 920 - protein, 15 aa, Blattella germanica
KLYKMAVAFMLAYPY

SEQ ID NO: 921 - protein, 15 aa, Blattella germanica
AVAFMLAYPYGYPRV

SEQ ID NO: 922 - protein, 15 aa, Blattella germanica
GYPRVMSSFSFDNSD

SEQ ID NO: 923 - protein, 15 aa, Blattella germanica
DGNGNIISPSINADG

SEQ ID NO: 924 - protein, 15 aa, Blattella germanica
WVCEHRWRQIFNMVG

SEQ ID NO: 925 - protein, 15 aa, Blattella germanica
RWRQIFNMVGFRNAV

SEQ ID NO: 926 - protein, 15 aa, Blattella germanica
FNMVGFRNAVAGTAV

SEQ ID NO: 927 - protein, 15 aa, Blattella germanica
ISFCRGNKGFVAFND

SEQ ID NO: 928 - protein, 15 aa, Blattella germanica
EFNNDLKQTLQTCLP

SEQ ID NO: 929 - protein, 15 aa, Blattella germanica
YIEILSSADDGVLAI

SEQ ID NO: 930 - protein, 15 aa, Blattella germanica
SSADDGVLAIHVNSK

SEQ ID NO: 931 - protein, 15 aa, Blattella germanica
GVLAIHVNSKVGSKS

SEQ ID NO: 932 - protein, 15 aa, Blattella germanica
VLEKLEAGFAKLAAS

SEQ ID NO: 933 - protein, 15 aa, Blattella germanica
EAGFAKLAASDSKSL

SEQ ID NO: 934 - protein, 15 aa, Blattella germanica
KLAASDSKSLLRKYL

SEQ ID NO: 935 - protein, 15 aa, Blattella germanica
DSKSLLRKYLTKEVF

SEQ ID NO: 936 - protein, 15 aa, Blattella germanica
LRKYLTKEVFDNLKT

SEQ ID NO: 937 - protein, 15 aa, Blattella germanica
FGSTLLDVIQSGLEN

SEQ ID NO: 938 - protein, 15 aa, Blattella germanica
DAEAYTVFADLFDPI

SEQ ID NO: 939 - protein, 15 aa, Blattella germanica
AGEYIISTRVRCGRS

SEQ ID NO: 940 - protein, 15 aa, Blattella germanica
RCGRSMQGYPFNPCL

SEQ ID NO: 941 - protein, 15 aa, Blattella germanica
LIDDHFLFKEGDRFL

SEQ ID NO: 942 - protein, 15 aa, Blattella germanica
FLFKEGDRFLQHANA

SEQ ID NO: 943 - protein, 15 aa, Blattella germanica
GDRFLQHANACRFWP

SEQ ID NO: 944 - protein, 15 aa, Blattella germanica
TGRGIYHNDAKTFLV

SEQ ID NO: 945 - protein, 15 aa, Blattella germanica
WCNEEDHLRIISMQM

SEQ ID NO: 946 - protein, 15 aa, Blattella germanica
DHLRIISMQMGGDLG

SEQ ID NO: 947 - protein, 15 aa, Blattella germanica
QVYRRLVTAVNDIEK

SEQ ID NO: 948 - protein, 15 aa, Blattella germanica
NDIEKRVPFSHDDRL

SEQ ID NO: 949 - protein, 15 aa, Blattella germanica
RVPFSHDDRLGFLTF

SEQ ID NO: 950 - protein, 15 aa, Blattella germanica
HDDRLGFLTFCPTNL

SEQ ID NO: 951 - protein, 15 aa, Blattella germanica
GFLTFCPTNLGTTVR

SEQ ID NO: 952 - protein, 15 aa, Blattella germanica
CPTNLGTTVRASVRI

SEQ ID NO: 953 - protein, 15 aa, Blattella germanica
GTTVRASVRIKVPKL

SEQ ID NO: 954 - protein, 15 aa, Blattella germanica
ASVRIKVPKLAADKK

SEQ ID NO: 955 - protein, 15 aa, Blattella germanica
MPLQKLFARRIFDSR

SEQ ID NO: 956 - protein, 15 aa, Blattella germanica
LFARRIFDSRGNPTI

SEQ ID NO: 957 - protein, 15 aa, Blattella germanica
EVDLTTDLGLFRAAV

SEQ ID NO: 958 - protein, 15 aa, Blattella germanica
TDLGLFRAAVPSGAS

SEQ ID NO: 959 - protein, 15 aa, Blattella germanica
IDNVNKIIVPELLKQ

SEQ ID NO: 960 - protein, 15 aa, Blattella germanica
ELLKQSFEATQQKEI

SEQ ID NO: 961 - protein, 15 aa, Blattella germanica
DDFMLKLDGTPNKSK

SEQ ID NO: 962 - protein, 15 aa, Blattella germanica
PNKSKLGANAILGVS

SEQ ID NO: 963 - protein, 15 aa, Blattella germanica
LGANAILGVSIAVCK

SEQ ID NO: 964 - protein, 15 aa, Blattella germanica
KGVPLYRHIADLAGV

SEQ ID NO: 965 - protein, 15 aa, Blattella germanica
YRHIADLAGVPDVIL

SEQ ID NO: 966 - protein, 15 aa, Blattella germanica
GVPDVILPVPAFNVI

SEQ ID NO: 967 - protein, 15 aa, Blattella germanica
PDVILPVPAFNVING

SEQ ID NO: 968 - protein, 15 aa, Blattella germanica
QEFMILPTGAATFTE

SEQ ID NO: 969 - protein, 15 aa, Blattella germanica
SEVYHHLKNVIQGKF

SEQ ID NO: 970 - protein, 15 aa, Blattella germanica
HLKNVIQGKFGLDAT

SEQ ID NO: 971 - protein, 15 aa, Blattella germanica
IQGKFGLDATAVGDE

SEQ ID NO: 972 - protein, 15 aa, Blattella germanica
WIDKDQLTALYMEFI

SEQ ID NO: 973 - protein, 15 aa, Blattella germanica
QLTALYMEFIKEFPV

SEQ ID NO: 974 - protein, 15 aa, Blattella germanica
YMEFIKEFPVVSIED

SEQ ID NO: 975 - protein, 15 aa, Blattella germanica
HWDAWTAMTAATPIQ

SEQ ID NO: 976 - protein, 15 aa, Blattella germanica
TAMTAATPIQIVGDD

SEQ ID NO: 977 - protein, 15 aa, Blattella germanica
IVGDDLTVTNPTRIQ

SEQ ID NO: 978 - protein, 15 aa, Blattella germanica
LTVTNPTRIQTAIDK

SEQ ID NO: 979 - protein, 15 aa, Blattella germanica
KACNCLLLKVNQIGT

SEQ ID NO: 980 - protein, 15 aa, Blattella germanica
FIADLVVGLSTGQIK

SEQ ID NO: 981 - protein, 15 aa, Blattella germanica
RSERLAKYNQILRIE

SEQ ID NO: 982 - protein, 15 aa, Blattella germanica
MAKDIKFDIEARDKL

SEQ ID NO: 983 - protein, 15 aa, Blattella germanica
KKGVDALANAVKVTL

SEQ ID NO: 984 - protein, 15 aa, Blattella germanica
NVVLQKSFGGPQVTK

SEQ ID NO: 985 - protein, 15 aa, Blattella germanica
LEDPIENLGAQMVKE

SEQ ID NO: 986 - protein, 15 aa, Blattella germanica
DGTTTATVLAQAIVR

SEQ ID NO: 987 - protein, 15 aa, Blattella germanica
RALEAVIIDLRKQSR

SEQ ID NO: 988 - protein, 15 aa, Blattella germanica
VIIDLRKQSREVGGN

SEQ ID NO: 989 - protein, 15 aa, Blattella germanica
TEKIKQVASISANND

SEQ ID NO: 990 - protein, 15 aa, Blattella germanica
EGMQFDRGYQSPYFV

SEQ ID NO: 991 - protein, 15 aa, Blattella germanica
SPYFVTNTEKMITEF

SEQ ID NO: 992 - protein, 15 aa, Blattella germanica
DQPQILLSDKKIAAM

SEQ ID NO: 993 - protein, 15 aa, Blattella germanica
LLSDKKIAAMKDLLP

SEQ ID NO: 994 - protein, 15 aa, Blattella germanica
KIAAMKDLLPILEPV

SEQ ID NO: 995 - protein, 15 aa, Blattella germanica
KDLLPILEPVAQSGK

SEQ ID NO: 996 - protein, 15 aa, Blattella germanica
ILEPVAQSGKPLLII

SEQ ID NO: 997 - protein, 15 aa, Blattella germanica
GEALATLVVNKIRGT

SEQ ID NO: 998 - protein, 15 aa, Blattella germanica
TLVVNKIRGTLKVAA

SEQ ID NO: 999 - protein, 15 aa, Blattella germanica
KIRGTLKVAAIKAPG

SEQ ID NO: 1000 - protein, 15 aa, Blattella germanica
LKVAAIKAPGFGDRR

SEQ ID NO: 1001 - protein, 15 aa, Blattella germanica
KAMLEDIAILTGGSV

SEQ ID NO: 1002 - protein, 15 aa, Blattella germanica
DIAILTGGSVISEET

SEQ ID NO: 1003 - protein, 15 aa, Blattella germanica
GSKLEDVKLNMLGKA

SEQ ID NO: 1004 - protein, 15 aa, Blattella germanica
DVKLNMLGKAERVII

SEQ ID NO: 1005 - protein, 15 aa, Blattella germanica
QERLAKLAGGVAVLY

SEQ ID NO: 1006 - protein, 15 aa, Blattella germanica
VAVLYVGAASEVEMK

SEQ ID NO: 1007 - protein, 15 aa, Blattella germanica
VDDALNATRAAVEEG

SEQ ID NO: 1008 - protein, 15 aa, Blattella germanica
IVAGGGVALVRAINS

SEQ ID NO: 1009 - protein, 15 aa, Blattella germanica
GVALVRAINSLDNLR

SEQ ID NO: 1010 - protein, 15 aa, Blattella germanica
RAINSLDNLRGENAD

SEQ ID NO: 1011 - protein, 15 aa, Blattella germanica
QDTGIQIVRRSLEEP

SEQ ID NO: 1012 - protein, 15 aa, Blattella germanica
KIGEYKNMIAEGIID

SEQ ID NO: 1013 - protein, 15 aa, Blattella germanica
EGIIDPTKVARVALE

SEQ ID NO: 1014 - protein, 15 aa, Blattella germanica
PTKVARVALENAASV

SEQ ID NO: 1015 - protein, 15 aa, Blattella germanica
RVALENAASVSGMLL

SEQ ID NO: 1016 - protein, 15 aa, Blattella germanica
VTEIKKDENNAVPSM

SEQ ID NO: 1017 - protein, 15 aa, Blattella germanica
GWVTQIATNPKYPDM

SEQ ID NO: 1018 - protein, 15 aa, Blattella germanica
KYPDMILSCSRDKTL

SEQ ID NO: 1019 - protein, 15 aa, Blattella germanica
ILSCSRDKTLIVWKL

SEQ ID NO: 1020 - protein, 15 aa, Blattella germanica
RDKTLIVWKLTRDET

SEQ ID NO: 1021 - protein, 15 aa, Blattella germanica
GHSHFVSDVVLSSDG

SEQ ID NO: 1022 - protein, 15 aa, Blattella germanica
VSDVVLSSDGNYALS

SEQ ID NO: 1023 - protein, 15 aa, Blattella germanica
LSSDGNYALSGSWDK

SEQ ID NO: 1024 - protein, 15 aa, Blattella germanica
NYALSGSWDKTLRLW

SEQ ID NO: 1025 - protein, 15 aa, Blattella germanica
TLRLWDLAAGRTTRR

SEQ ID NO: 1026 - protein, 15 aa, Blattella germanica
KDVLSVAFSVDNRQI

SEQ ID NO: 1027 - protein, 15 aa, Blattella germanica
VAFSVDNRQIVSGSR

SEQ ID NO: 1028 - protein, 15 aa, Blattella germanica
DKTIKLWNTLAECKY

SEQ ID NO: 1029 - protein, 15 aa, Blattella germanica
VSCVRFSPNHSNPII

SEQ ID NO: 1030 - protein, 15 aa, Blattella germanica
FSPNHSNPIIVSAGW

SEQ ID NO: 1031 - protein, 15 aa, Blattella germanica
SNPIIVSAGWDKVVK

SEQ ID NO: 1032 - protein, 15 aa, Blattella germanica
DKVVKVWNLTNCKLK

SEQ ID NO: 1033 - protein, 15 aa, Blattella germanica
VWNLTNCKLKINHIG

SEQ ID NO: 1034 - protein, 15 aa, Blattella germanica
NCKLKINHIGHTGYL

SEQ ID NO: 1035 - protein, 15 aa, Blattella germanica
GKDCKAMLWDLNDGK

SEQ ID NO: 1036 - protein, 15 aa, Blattella germanica
AMLWDLNDGKHLHTL

SEQ ID NO: 1037 - protein, 15 aa, Blattella germanica
DHNDIITALCFSPNR

SEQ ID NO: 1038 - protein, 15 aa, Blattella germanica
ITALCFSPNRYWLCA

SEQ ID NO: 1039 - protein, 15 aa, Blattella germanica
YWLCAAFGPSIKIWD

SEQ ID NO: 1040 - protein, 15 aa, Blattella germanica
QTLFAGYFDNTIRVW

SEQ ID NO: 1041 - protein, 15 aa, Blattella germanica
GYFDNTIRVWQVSVF

SEQ ID NO: 1042 - protein, 15 aa, Blattella germanica
FDNTIRVWQVSVFAR

SEQ ID NO: 1043 - protein, 15 aa, Blattella germanica
MGRKFWVGGNWKMNG

SEQ ID NO: 1044 - protein, 15 aa, Blattella germanica
EEIVKFLAAGPLDPN

SEQ ID NO: 1045 - protein, 15 aa, Blattella germanica
VEVVVGIPAIYLEST

SEQ ID NO: 1046 - protein, 15 aa, Blattella germanica
GIPAIYLESTKNILP

SEQ ID NO: 1047 - protein, 15 aa, Blattella germanica
YLESTKNILPSNVAA

SEQ ID NO: 1048 - protein, 15 aa, Blattella germanica
KNILPSNVAAAAQNC

SEQ ID NO: 1049 - protein, 15 aa, Blattella germanica
GAFTGEISPAMLNDI

SEQ ID NO: 1050 - protein, 15 aa, Blattella germanica
EISPAMLNDIGINWV

SEQ ID NO: 1051 - protein, 15 aa, Blattella germanica
MLNDIGINWVILGHS

SEQ ID NO: 1052 - protein, 15 aa, Blattella germanica
GINWVILGHSERRNV

SEQ ID NO: 1053 - protein, 15 aa, Blattella germanica
FGEKDDLISDKVVHA

SEQ ID NO: 1054 - protein, 15 aa, Blattella germanica
DLISDKVVHALESGL

SEQ ID NO: 1055 - protein, 15 aa, Blattella germanica
KVVHALESGLNVVAC

SEQ ID NO: 1056 - protein, 15 aa, Blattella germanica
GKTEEVVFQQTKAIA

SEQ ID NO: 1057 - protein, 15 aa, Blattella germanica
VVFQQTKAIADKIKD

SEQ ID NO: 1058 - protein, 15 aa, Blattella germanica
DKIKDWSKVVIAYEP

SEQ ID NO: 1059 - protein, 15 aa, Blattella germanica
WSKVVIAYEPVWAIG

SEQ ID NO: 1060 - protein, 15 aa, Blattella germanica
IAYEPVWAIGTGKTA

SEQ ID NO: 1061 - protein, 15 aa, Blattella germanica
QDVHKKLREWLSKNV

SEQ ID NO: 1062 - protein, 15 aa, Blattella germanica
DGFLVGGASLKPEFV

SEQ ID NO: 1063 - protein, 15 aa, Blattella germanica
GGASLKPEFVQIINA

SEQ ID NO: 1064 - protein, 15 aa, Blattella germanica
ASLKPEFVQIINAKN

SEQ ID NO: 1065 - protein, 15 aa, Blattella germanica
MFRLVVIATLLVASC

SEQ ID NO: 1066 - protein, 15 aa, Blattella germanica
VIATLLVASCLGAAT

SEQ ID NO: 1067 - protein, 15 aa, Blattella germanica
QLQFEYYGSLMCGAS

SEQ ID NO: 1068 - protein, 15 aa, Blattella germanica
YWTIDFDIAVARVST

SEQ ID NO: 1069 - protein, 15 aa, Blattella germanica
DYDGITANMICAAVP

SEQ ID NO: 1070 - protein, 15 aa, Blattella germanica
YPGVYSNVATLRDFV

SEQ ID NO: 1071 - protein, 15 aa, Blattella germanica
MTWNALLCCLLVSAA

SEQ ID NO: 1072 - protein, 15 aa, Blattella germanica
NALLCCLLVSAASAI

SEQ ID NO: 1073 - protein, 15 aa, Blattella germanica
AASAITPGWLPINSQ

SEQ ID NO: 1074 - protein, 15 aa, Blattella germanica
VANQYTGILYKARLS

SEQ ID NO: 1075 - protein, 15 aa, Blattella germanica
KARLSLDRNEDQLIT

SEQ ID NO: 1076 - protein, 15 aa, Blattella germanica
LDRNEDQLITGKVTE

SEQ ID NO: 1077 - protein, 15 aa, Blattella germanica
DQLITGKVTEAQFSP

SEQ ID NO: 1078 - protein, 15 aa, Blattella germanica
GKVTEAQFSPVNTQF

SEQ ID NO: 1079 - protein, 15 aa, Blattella germanica
AQFSPVNTQFSSGWD

SEQ ID NO: 1080 - protein, 15 aa, Blattella germanica
VNTQFSSGWDESVPD

SEQ ID NO: 1081 - protein, 15 aa, Blattella germanica
SSGWDESVPDEKLHW

SEQ ID NO: 1082 - protein, 15 aa, Blattella germanica
ESVPDEKLHWDVVPM

SEQ ID NO: 1083 - protein, 15 aa, Blattella germanica
QIELNSRGEVRKLRV

SEQ ID NO: 1084 - protein, 15 aa, Blattella germanica
VVVDEDKKVYRVFES

SEQ ID NO: 1085 - protein, 15 aa, Blattella germanica
RVFESTVTGRCEALY

SEQ ID NO: 1086 - protein, 15 aa, Blattella germanica
TVTGRCEALYEVDHL

SEQ ID NO: 1087 - protein, 15 aa, Blattella germanica
CEALYEVDHLYPTTY

SEQ ID NO: 1088 - protein, 15 aa, Blattella germanica
EVDHLYPTTYLNPWQ

SEQ ID NO: 1089 - protein, 15 aa, Blattella germanica
YPTTYLNPWQWTQQH

SEQ ID NO: 1090 - protein, 15 aa, Blattella germanica
LNPWQWTQQHDTKLR

SEQ ID NO: 1091 - protein, 15 aa, Blattella germanica
WTQQHDTKLRIMKTH

SEQ ID NO: 1092 - protein, 15 aa, Blattella germanica
DTKLRIMKTHQFTNC

SEQ ID NO: 1093 - protein, 15 aa, Blattella germanica
IMKTHQFTNCRHNSA

SEQ ID NO: 1094 - protein, 15 aa, Blattella germanica
NAFEYFHLKQHKPET

SEQ ID NO: 1095 - protein, 15 aa, Blattella germanica
AVSRVIADGDNLKNF

SEQ ID NO: 1096 - protein, 15 aa, Blattella germanica
IADGDNLKNFTFYSG

SEQ ID NO: 1097 - protein, 15 aa, Blattella germanica
IVLNPEIYNKQKGML

SEQ ID NO: 1098 - protein, 15 aa, Blattella germanica
VSHINVTVERKGREL

SEQ ID NO: 1099 - protein, 15 aa, Blattella germanica
VTVERKGRELTVIDY

SEQ ID NO: 1100 - protein, 15 aa, Blattella germanica
ELRNVGDLSYSTSLV

SEQ ID NO: 1101 - protein, 15 aa, Blattella germanica
RNSASMDLSSSSMSS

SEQ ID NO: 1102 - protein, 15 aa, Blattella germanica
MDLSSSSMSSSSSSS

SEQ ID NO: 1103 - protein, 15 aa, Blattella germanica
SSMSSSSSSSSSSSS

SEQ ID NO: 1104 - protein, 15 aa, Blattella germanica
SSSSSSSSSSSSSSS

SEQ ID NO: 1105 - protein, 15 aa, Blattella germanica
SSSSSSSSSSSSSSS

SEQ ID NO: 1106 - protein, 15 aa, Blattella germanica
SSSSSSSSSSSEEHH

SEQ ID NO: 1107 - protein, 15 aa, Blattella germanica
SSSSSSEEHHSHNQK

SEQ ID NO: 1108 - protein, 15 aa, Blattella germanica
SEEHHSHNQKLSKKR

SEQ ID NO: 1109 - protein, 15 aa, Blattella germanica
QVPLPRPLFEANFDA

SEQ ID NO: 1110 - protein, 15 aa, Blattella germanica
RPLFEANFDASSGLT

SEQ ID NO: 1111 - protein, 15 aa, Blattella germanica
ANFDASSGLTTEQPV

SEQ ID NO: 1112 - protein, 15 aa, Blattella germanica
SSGLTTEQPVTFRPR

SEQ ID NO: 1113 - protein, 15 aa, Blattella germanica
TEQPVTFRPRRQLFQ

SEQ ID NO: 1114 - protein, 15 aa, Blattella germanica
TFRPRRQLFQGQDMS

SEQ ID NO: 1115 - protein, 15 aa, Blattella germanica
RQLFQGQDMSEEETE

SEQ ID NO: 1116 - protein, 15 aa, Blattella germanica
GQDMSEEETEQNPEI

SEQ ID NO: 1117 - protein, 15 aa, Blattella germanica
EEETEQNPEIIPANL

SEQ ID NO: 1118 - protein, 15 aa, Blattella germanica
LIHNTKQVDVDPVGV

SEQ ID NO: 1119 - protein, 15 aa, Blattella germanica
KQVDVDPVGVAVRLS

SEQ ID NO: 1120 - protein, 15 aa, Blattella germanica
KDIAADLQGEPRVGE

SEQ ID NO: 1121 - protein, 15 aa, Blattella germanica
DLQGEPRVGEDRHIL

SEQ ID NO: 1122 - protein, 15 aa, Blattella germanica
PRVGEDRHILPRFTI

SEQ ID NO: 1123 - protein, 15 aa, Blattella germanica
AARKLYKLENDHPNY

SEQ ID NO: 1124 - protein, 15 aa, Blattella germanica
DHPNYMNWDTWRVYR

SEQ ID NO: 1125 - protein, 15 aa, Blattella germanica
MNWDTWRVYRDAVSQ

SEQ ID NO: 1126 - protein, 15 aa, Blattella germanica
WRVYRDAVSQAGTWS

SEQ ID NO: 1127 - protein, 15 aa, Blattella germanica
DAVSQAGTWSALNSI

SEQ ID NO: 1128 - protein, 15 aa, Blattella germanica
SEMVEPKEASHLITV

SEQ ID NO: 1129 - protein, 15 aa, Blattella germanica
LPAAVSDKNKAYLHF

SEQ ID NO: 1130 - protein, 15 aa, Blattella germanica
SDKNKAYLHFLFEMT

SEQ ID NO: 1131 - protein, 15 aa, Blattella germanica
IPYLVQEFDDAVKEN

SEQ ID NO: 1132 - protein, 15 aa, Blattella germanica
EHNPRKVIDLLLSLY

SEQ ID NO: 1133 - protein, 15 aa, Blattella germanica
LDQNEHADIRVEALF

SEQ ID NO: 1134 - protein, 15 aa, Blattella germanica
AELTHTESNNQVLSA

SEQ ID NO: 1135 - protein, 15 aa, Blattella germanica
TESNNQVLSASQSAI

SEQ ID NO: 1136 - protein, 15 aa, Blattella germanica
SQSAIKSAANVEGDI

SEQ ID NO: 1137 - protein, 15 aa, Blattella germanica
KSAANVEGDIYSEMR

SEQ ID NO: 1138 - protein, 15 aa, Blattella germanica
VEGDIYSEMRRKAKA

SEQ ID NO: 1139 - protein, 15 aa, Blattella germanica
RKAKAVEHLLSTRNM

SEQ ID NO: 1140 - protein, 15 aa, Blattella germanica
KINYDSLYNLNYIGS

SEQ ID NO: 1141 - protein, 15 aa, Blattella germanica
SLYNLNYIGSEDSIY

SEQ ID NO: 1142 - protein, 15 aa, Blattella germanica
NYIGSEDSIYPKSML

SEQ ID NO: 1143 - protein, 15 aa, Blattella germanica
NNLGRINTHVQKGYM

SEQ ID NO: 1144 - protein, 15 aa, Blattella germanica
INTHVQKGYMVSSMT

SEQ ID NO: 1145 - protein, 15 aa, Blattella germanica
VSSMTDLWEAFHTIY

SEQ ID NO: 1146 - protein, 15 aa, Blattella germanica
FHTIYKKDNGSPTDP

SEQ ID NO: 1147 - protein, 15 aa, Blattella germanica
KKDNGSPTDPKTLVK

SEQ ID NO: 1148 - protein, 15 aa, Blattella germanica
SPTDPKTLVKFVEGN

SEQ ID NO: 1149 - protein, 15 aa, Blattella germanica
FVEGNLKYFNMGVQK

SEQ ID NO: 1150 - protein, 15 aa, Blattella germanica
KTYKKPTNFNHTKLS

SEQ ID NO: 1151 - protein, 15 aa, Blattella germanica
TLTLPCAMGLPAYFK

SEQ ID NO: 1152 - protein, 15 aa, Blattella germanica
CAMGLPAYFKMNSPS

SEQ ID NO: 1153 - protein, 15 aa, Blattella germanica
LWKYNGEFSIQTDAK

SEQ ID NO: 1154 - protein, 15 aa, Blattella germanica
QTDAKTDVPMSLENF

SEQ ID NO: 1155 - protein, 15 aa, Blattella germanica
HAQLAFSTAFDNKEY

SEQ ID NO: 1156 - protein, 15 aa, Blattella germanica
FSTAFDNKEYISGLD

SEQ ID NO: 1157 - protein, 15 aa, Blattella germanica
DNKEYISGLDRKVEV

SEQ ID NO: 1158 - protein, 15 aa, Blattella germanica
ISGLDRKVEVHVPVK

SEQ ID NO: 1159 - protein, 15 aa, Blattella germanica
IIPLFTDRDYDVLQW

SEQ ID NO: 1160 - protein, 15 aa, Blattella germanica
TDRDYDVLQWQTIPY

SEQ ID NO: 1161 - protein, 15 aa, Blattella germanica
TTIHNVPDFETVYMD

SEQ ID NO: 1162 - protein, 15 aa, Blattella germanica
TAHFEKKMGENTGIV

SEQ ID NO: 1163 - protein, 15 aa, Blattella germanica
KKMGENTGIVFKVKY

SEQ ID NO: 1164 - protein, 15 aa, Blattella germanica
DTDQEFLDTKWFLDE

SEQ ID NO: 1165 - protein, 15 aa, Blattella germanica
LFTGLNYDVPTKDIF

SEQ ID NO: 1166 - protein, 15 aa, Blattella germanica
NYDVPTKDIFYNNLT

SEQ ID NO: 1167 - protein, 15 aa, Blattella germanica
YNNLTVYYDHEDTKN

SEQ ID NO: 1168 - protein, 15 aa, Blattella germanica
VYYDHEDTKNHAVSF

SEQ ID NO: 1169 - protein, 15 aa, Blattella germanica
EDTKNHAVSFTVTKE

SEQ ID NO: 1170 - protein, 15 aa, Blattella germanica
HAVSFTVTKEQSKFY

SEQ ID NO: 1171 - protein, 15 aa, Blattella germanica
TVTKEQSKFYETLNP

SEQ ID NO: 1172 - protein, 15 aa, Blattella germanica
LKLSSGKKQKHRNVK

SEQ ID NO: 1173 - protein, 15 aa, Blattella germanica
GKKQKHRNVKSHRIR

SEQ ID NO: 1174 - protein, 15 aa, Blattella germanica
SHRIRREYTEDENPA

SEQ ID NO: 1175 - protein, 15 aa, Blattella germanica
REYTEDENPAIPKDK

SEQ ID NO: 1176 - protein, 15 aa, Blattella germanica
DENPAIPKDKQPNSH

SEQ ID NO: 1177 - protein, 15 aa, Blattella germanica
IPKDKQPNSHPRRQE

SEQ ID NO: 1178 - protein, 15 aa, Blattella germanica
QPNSHPRRQEYLSKS

SEQ ID NO: 1179 - protein, 15 aa, Blattella germanica
MALTGDATAVVLDMT

SEQ ID NO: 1180 - protein, 15 aa, Blattella germanica
VLDMTLKFEGPAESY

SEQ ID NO: 1181 - protein, 15 aa, Blattella germanica
LKFEGPAESYFTTTV

SEQ ID NO: 1182 - protein, 15 aa, Blattella germanica
FYDQHYYEEKKRNQF

SEQ ID NO: 1183 - protein, 15 aa, Blattella germanica
YYEEKKRNQFCLSWS

SEQ ID NO: 1184 - protein, 15 aa, Blattella germanica
EFDPNSKVHAIMNIG

SEQ ID NO: 1185 - protein, 15 aa, Blattella germanica
IMNIGKECENGGSAV

SEQ ID NO: 1186 - protein, 15 aa, Blattella germanica
KECENGGSAVANIDM

SEQ ID NO: 1187 - protein, 15 aa, Blattella germanica
KNLTVSKLCDHEMRT

SEQ ID NO: 1188 - protein, 15 aa, Blattella germanica
SKLCDHEMRTKRDHV

SEQ ID NO: 1189 - protein, 15 aa, Blattella germanica
HEMRTKRDHVLPACR

SEQ ID NO: 1190 - protein, 15 aa, Blattella germanica
KRDHVLPACRNSTER

SEQ ID NO: 1191 - protein, 15 aa, Blattella germanica
LPACRNSTERASDLN

SEQ ID NO: 1192 - protein, 15 aa, Blattella germanica
NSTERASDLNRVHVD

SEQ ID NO: 1193 - protein, 15 aa, Blattella germanica
INYNLKQHETFKRRV

SEQ ID NO: 1194 - protein, 15 aa, Blattella germanica
KQHETFKRRVYKVYD

SEQ ID NO: 1195 - protein, 15 aa, Blattella germanica
LYPHVSEDVIVDNPA

SEQ ID NO: 1196 - protein, 15 aa, Blattella germanica
DNTRAFNVSIETPVL

SEQ ID NO: 1197 - protein, 15 aa, Blattella germanica
FNVSIETPVLSVNAT

SEQ ID NO: 1198 - protein, 15 aa, Blattella germanica
ETPVLSVNATSVRLQ

SEQ ID NO: 1199 - protein, 15 aa, Blattella germanica
SVNATSVRLQSWQSE

SEQ ID NO: 1200 - protein, 15 aa, Blattella germanica
SVRLQSWQSEMLRMN

SEQ ID NO: 1201 - protein, 15 aa, Blattella germanica
PRTSFAKRFAKWALP

SEQ ID NO: 1202 - protein, 15 aa, Blattella germanica
AKRFAKWALPLYYKP

SEQ ID NO: 1203 - protein, 15 aa, Blattella germanica
KWALPLYYKPTCVVD

SEQ ID NO: 1204 - protein, 15 aa, Blattella germanica
LYYKPTCVVDSSYIN

SEQ ID NO: 1205 - protein, 15 aa, Blattella germanica
TCVVDSSYINTFDNF

SEQ ID NO: 1206 - protein, 15 aa, Blattella germanica
ILDIPQKFNMEYFKV

SEQ ID NO: 1207 - protein, 15 aa, Blattella germanica
AFKPTSPVPNMQREV

SEQ ID NO: 1208 - protein, 15 aa, Blattella germanica
SPVPNMQREVLVFLR

SEQ ID NO: 1209 - protein, 15 aa, Blattella germanica
NAKIELKPNQGMPEV

SEQ ID NO: 1210 - protein, 15 aa, Blattella germanica
LKPNQGMPEVYVEGK

SEQ ID NO: 1211 - protein, 15 aa, Blattella germanica
GMPEVYVEGKRVDYN

SEQ ID NO: 1212 - protein, 15 aa, Blattella germanica
YVEGKRVDYNHHHST

SEQ ID NO: 1213 - protein, 15 aa, Blattella germanica
RVDYNHHHSTDLNVS

SEQ ID NO: 1214 - protein, 15 aa, Blattella germanica
HHHSTDLNVSQDRIG

SEQ ID NO: 1215 - protein, 15 aa, Blattella germanica
DLNVSQDRIGYVYAL

SEQ ID NO: 1216 - protein, 15 aa, Blattella germanica
QDRIGYVYALPTKAA

SEQ ID NO: 1217 - protein, 15 aa, Blattella germanica
YVYALPTKAAHIVFP

SEQ ID NO: 1218 - protein, 15 aa, Blattella germanica
PTKAAHIVFPSYEIE

SEQ ID NO: 1219 - protein, 15 aa, Blattella germanica
HIVFPSYEIEMFYDG

SEQ ID NO: 1220 - protein, 15 aa, Blattella germanica
SYEIEMFYDGSRIMI

SEQ ID NO: 1221 - protein, 15 aa, Blattella germanica
MFYDGSRIMIQASNM

SEQ ID NO: 1222 - protein, 15 aa, Blattella germanica
SRIMIQASNMYRNFT

SEQ ID NO: 1223 - protein, 15 aa, Blattella germanica
QASNMYRNFTKGLCG

SEQ ID NO: 1224 - protein, 15 aa, Blattella germanica
YRNFTKGLCGNMDGE

SEQ ID NO: 1225 - protein, 15 aa, Blattella germanica
KGLCGNMDGEFVNDV

SEQ ID NO: 1226 - protein, 15 aa, Blattella germanica
NMDGEFVNDVLTPWG

SEQ ID NO: 1227 - protein, 15 aa, Blattella germanica
FVNDVLTPWGCYAKD

SEQ ID NO: 1228 - protein, 15 aa, Blattella germanica
LTPWGCYAKDMALFV

SEQ ID NO: 1229 - protein, 15 aa, Blattella germanica
CYAKDMALFVASYAD

SEQ ID NO: 1230 - protein, 15 aa, Blattella germanica
MALFVASYADNSNSE

SEQ ID NO: 1231 - protein, 15 aa, Blattella germanica
ASYADNSNSEVRKIK

SEQ ID NO: 1232 - protein, 15 aa, Blattella germanica
NSNSEVRKIKATQNE

SEQ ID NO: 1233 - protein, 15 aa, Blattella germanica
VRKIKATQNEQTCVP

SEQ ID NO: 1234 - protein, 15 aa, Blattella germanica
ATQNEQTCVPQFHQP

SEQ ID NO: 1235 - protein, 15 aa, Blattella germanica
QTCVPQFHQPLVSHQ

SEQ ID NO: 1236 - protein, 15 aa, Blattella germanica
QFHQPLVSHQMRLSQ

SEQ ID NO: 1237 - protein, 15 aa, Blattella germanica
LVSHQMRLSQVIKLA

SEQ ID NO: 1238 - protein, 15 aa, Blattella germanica
MRLSQVIKLADTSSS

SEQ ID NO: 1239 - protein, 15 aa, Blattella germanica
VIKLADTSSSSESSS

SEQ ID NO: 1240 - protein, 15 aa, Blattella germanica
DTSSSSESSSSSESH

SEQ ID NO: 1241 - protein, 15 aa, Blattella germanica
SESSSSSESHENNSS

SEQ ID NO: 1242 - protein, 15 aa, Blattella germanica
SSESHENNSSPSSES

SEQ ID NO: 1243 - protein, 15 aa, Blattella germanica
ENNSSPSSESQVNKS

SEQ ID NO: 1244 - protein, 15 aa, Blattella germanica
PSSESQVNKSKRQPN

SEQ ID NO: 1245 - protein, 15 aa, Blattella germanica
QVNKSKRQPNSRPRS

SEQ ID NO: 1246 - protein, 15 aa, Blattella germanica
KRQPNSRPRSSSSSS

SEQ ID NO: 1247 - protein, 15 aa, Blattella germanica
SRPRSSSSSSSSSSS

SEQ ID NO: 1248 - protein, 15 aa, Blattella germanica
SSSSSSSSSSESNES

SEQ ID NO: 1249 - protein, 15 aa, Blattella germanica
SSSSSESNESVLAKK

SEQ ID NO: 1250 - protein, 15 aa, Blattella germanica
ESNESVLAKKIINNQ

SEQ ID NO: 1251 - protein, 15 aa, Blattella germanica
VLAKKIINNQIGPKP

SEQ ID NO: 1252 - protein, 15 aa, Blattella germanica
IINNQIGPKPTLIPS

SEQ ID NO: 1253 - protein, 15 aa, Blattella germanica
IGPKPTLIPSQSPMT

SEQ ID NO: 1254 - protein, 15 aa, Blattella germanica
TLIPSQSPMTSDDKC

SEQ ID NO: 1255 - protein, 15 aa, Blattella germanica
QSPMTSDDKCMTQQP

SEQ ID NO: 1256 - protein, 15 aa, Blattella germanica
SDDKCMTQQPRHTYY

SEQ ID NO: 1257 - protein, 15 aa, Blattella germanica
MTQQPRHTYYENQFC

SEQ ID NO: 1258 - protein, 15 aa, Blattella germanica
RHTYYENQFCVSEKP

SEQ ID NO: 1259 - protein, 15 aa, Blattella germanica
ENQFCVSEKPLDTCM

SEQ ID NO: 1260 - protein, 15 aa, Blattella germanica
VSEKPLDTCMPLICH

SEQ ID NO: 1261 - protein, 15 aa, Blattella germanica
LDTCMPLICHATESY

SEQ ID NO: 1262 - protein, 15 aa, Blattella germanica
PLICHATESYTIDVN

SEQ ID NO: 1263 - protein, 15 aa, Blattella germanica
ATESYTIDVNFYCVP

SEQ ID NO: 1264 - protein, 15 aa, Blattella germanica
TIDVNFYCVPLGPAA

SEQ ID NO: 1265 - protein, 15 aa, Blattella germanica
FYCVPLGPAANHYMK

SEQ ID NO: 1266 - protein, 15 aa, Blattella germanica
LGPAANHYMKLVKKG

SEQ ID NO: 1267 - protein, 15 aa, Blattella germanica
NHYMKLVKKGILPDL

SEQ ID NO: 1268 - protein, 15 aa, Blattella germanica
LVKKGILPDLSRNRN

SEQ ID NO: 1269 - protein, 15 aa, Blattella germanica
ILPDLSRNRNGKRVV

SEQ ID NO: 1270 - protein, 15 aa, Blattella germanica
SRNRNGKRVVLPVEI

SEQ ID NO: 1271 - protein, 15 aa, Blattella germanica
GKRVVLPVEIPIQCE

SEQ ID NO: 1272 - protein, 15 aa, Blattella germanica
VLPVEIPIQCEPVLN

SEQ ID NO: 1273 - protein, 15 aa, Blattella germanica
SCITYQRGSHAGNKL

SEQ ID NO: 1274 - protein, 15 aa, Blattella germanica
AGNKLAMQEFMILPT

SEQ ID NO: 1275 - protein, 15 aa, Blattella germanica
NKLAMQEFMILPTGA

SEQ ID NO: 1276 - protein, 15 aa, Blattella germanica
AMQEFMILPTGAATF

SEQ ID NO: 1277 - protein, 15 aa, Blattella germanica
MGSEVYHHLKNVIKG

SEQ ID NO: 1278 - protein, 15 aa, Blattella germanica
YHHLKNVIKGKFGLD

SEQ ID NO: 1279 - protein, 15 aa, Blattella germanica
KDGLDLIKDAIEKAG

SEQ ID NO: 1280 - protein, 15 aa, Blattella germanica
LDLIKDAIEKAGYTG

SEQ ID NO: 1281 - protein, 15 aa, Blattella germanica
LIKDAIEKAGYTGKI

SEQ ID NO: 1282 - protein, 15 aa, Blattella germanica
KIEIGMDVAASEFFR

SEQ ID NO: 1283 - protein, 15 aa, Blattella germanica
KYDLDFKNPNTDKSK

SEQ ID NO: 1284 - protein, 15 aa, Blattella germanica
SKWIDKDQLTALYME

SEQ ID NO: 1285 - protein, 15 aa, Blattella germanica
KDQLTALYMEFIKEF

SEQ ID NO: 1286 - protein, 15 aa, Blattella germanica
ALYMEFIKEFPVVSI

SEQ ID NO: 1287 - protein, 15 aa, Blattella germanica
FIKEFPVVSIEDPFD

SEQ ID NO: 1288 - protein, 15 aa, Blattella germanica
QDHWDAWTAMTAATP

SEQ ID NO: 1289 - protein, 15 aa, Blattella germanica
AWTAMTAATPIQIVG

SEQ ID NO: 1290 - protein, 15 aa, Blattella germanica
DDLTVTNPTRIQTAI

SEQ ID NO: 1291 - protein, 15 aa, Blattella germanica
NCLLLKVNQIGTVTE

SEQ ID NO: 1292 - protein, 15 aa, Blattella germanica
LLLKVNQIGTVTESI

SEQ ID NO: 1293 - protein, 15 aa, Blattella germanica
GTVTESIQAHTLAKA

SEQ ID NO: 1294 - protein, 15 aa, Blattella germanica
VTESIQAHTLAKANG

SEQ ID NO: 1295 - protein, 15 aa, Blattella germanica
NGWGTMVSHRSGETE

SEQ ID NO: 1296 - protein, 15 aa, Blattella germanica
WGTMVSHRSGETEDS

SEQ ID NO: 1297 - protein, 15 aa, Blattella germanica
ETEDSFIADLVVGLS

SEQ ID NO: 1298 - protein, 15 aa, Blattella germanica
DSFIADLVVGLSTGQ

SEQ ID NO: 1299 - protein, 15 aa, Blattella germanica
PCRSERLAKYNQILR

SEQ ID NO: 1300 - protein, 15 aa, Blattella germanica
RLAKYNQILRIEEEL

SEQ ID NO: 1301 - protein, 15 aa, Blattella germanica
AKYNQILRIEEELGD

SEQ ID NO: 1302 - protein, 15 aa, Blattella germanica
NALLCCLLVSAASAI

SEQ ID NO: 1303 - protein, 15 aa, Blattella germanica
ALLCCLLVSAASAIT

SEQ ID NO: 1304 - protein, 15 aa, Blattella germanica
CLLVSAASAITPGWL

SEQ ID NO: 1305 - protein, 15 aa, Blattella germanica
TPGWLPINSQLDYHV

SEQ ID NO: 1306 - protein, 15 aa, Blattella germanica
PINSQLDYHVHGRTF

SEQ ID NO: 1307 - protein, 15 aa, Blattella germanica
LDYHVHGRTFSSLFQ

SEQ ID NO: 1308 - protein, 15 aa, Blattella germanica
HGRTFSSLFQVANQY

SEQ ID NO: 1309 - protein, 15 aa, Blattella germanica
SSLFQVANQYTGILY

SEQ ID NO: 1310 - protein, 15 aa, Blattella germanica
TGILYKARLSLDRNE

SEQ ID NO: 1311 - protein, 15 aa, Blattella germanica
EKLHWDVVPMSQQPF

SEQ ID NO: 1312 - protein, 15 aa, Blattella germanica
DVVPMSQQPFQIELN

SEQ ID NO: 1313 - protein, 15 aa, Blattella germanica
SQQPFQIELNSRGEV

SEQ ID NO: 1314 - protein, 15 aa, Blattella germanica
SRGEVRKLRVNKFVE

SEQ ID NO: 1315 - protein, 15 aa, Blattella germanica
RKLRVNKFVELWEIN

SEQ ID NO: 1316 - protein, 15 aa, Blattella germanica
NKFVELWEINMIKAI

SEQ ID NO: 1317 - protein, 15 aa, Blattella germanica
LWEINMIKAIISQLQ

SEQ ID NO: 1318 - protein, 15 aa, Blattella germanica
MIKAIISQLQVVVDE

SEQ ID NO: 1319 - protein, 15 aa, Blattella germanica
ISQLQVVVDEDKKVY

SEQ ID NO: 1320 - protein, 15 aa, Blattella germanica
DKKVYRVFESTVTGR

SEQ ID NO: 1321 - protein, 15 aa, Blattella germanica
DTKLRIMKNHQFTNC

SEQ ID NO: 1322 - protein, 15 aa, Blattella germanica
QFTNCRHNSAYKLHF

SEQ ID NO: 1323 - protein, 15 aa, Blattella germanica
RHNSAYKLHFNAFEY

SEQ ID NO: 1324 - protein, 15 aa, Blattella germanica
YKLHFNAFEYFHLKQ

SEQ ID NO: 1325 - protein, 15 aa, Blattella germanica
FHLKQHKPETFLSNS

SEQ ID NO: 1326 - protein, 15 aa, Blattella germanica
HKPETFLSNSAVSRV

SEQ ID NO: 1327 - protein, 15 aa, Blattella germanica
FLSNSAVSRVIADGD

SEQ ID NO: 1328 - protein, 15 aa, Blattella germanica
NLKNFTFYSGETIHK

SEQ ID NO: 1329 - protein, 15 aa, Blattella germanica
TFYSGETIHKIVLNP

SEQ ID NO: 1330 - protein, 15 aa, Blattella germanica
ETIHKIVLNPEIYNK

SEQ ID NO: 1331 - protein, 15 aa, Blattella germanica
EIYNKQKGMLVSHIN

SEQ ID NO: 1332 - protein, 15 aa, Blattella germanica
QKGMLVSHINVTVER

SEQ ID NO: 1333 - protein, 15 aa, Blattella germanica
KGRELTVIDYELRNV

SEQ ID NO: 1334 - protein, 15 aa, Blattella germanica
TVIDYELRNVGDLSY

SEQ ID NO: 1335 - protein, 15 aa, Blattella germanica
GDLSYSTSLVKAHSM

SEQ ID NO: 1336 - protein, 15 aa, Blattella germanica
STSLVKAHSMRNSAS

SEQ ID NO: 1337 - protein, 15 aa, Blattella germanica
KAHSMRNSASMDLSS

SEQ ID NO: 1338 - protein, 15 aa, Blattella germanica
SHNQKLSKKRQVPLP

SEQ ID NO: 1339 - protein, 15 aa, Blattella germanica
LSKKRQVPLPRPLFE

SEQ ID NO: 1340 - protein, 15 aa, Blattella germanica
QNPEIIPANLLPTYN

SEQ ID NO: 1341 - protein, 15 aa, Blattella germanica
IPANLLPTYNLIHNT

SEQ ID NO: 1342 - protein, 15 aa, Blattella germanica
LPTYNLIHNTKQVDV

SEQ ID NO: 1343 - protein, 15 aa, Blattella germanica
DPVGVAVRLSKDIAA

SEQ ID NO: 1344 - protein, 15 aa, Blattella germanica
AVRLSKDIAADLQGE

SEQ ID NO: 1345 - protein, 15 aa, Blattella germanica
DRHILPRFTILVRLL

SEQ ID NO: 1346 - protein, 15 aa, Blattella germanica
PRFTILVRLLKQLKV

SEQ ID NO: 1347 - protein, 15 aa, Blattella germanica
LVRLLKQLKVSQIME

SEQ ID NO: 1348 - protein, 15 aa, Blattella germanica
KQLKVSQIMEAARKL

SEQ ID NO: 1349 - protein, 15 aa, Blattella germanica
SQIMEAARKLYKLEN

SEQ ID NO: 1350 - protein, 15 aa, Blattella germanica
YKLENDHPNYMNWDT

SEQ ID NO: 1351 - protein, 15 aa, Blattella germanica
AGTWSALNSIQQFIS

SEQ ID NO: 1352 - protein, 15 aa, Blattella germanica
ALNSIQQFISSEMVE

SEQ ID NO: 1353 - protein, 15 aa, Blattella germanica
QQFISSEMVEPKEAS

SEQ ID NO: 1354 - protein, 15 aa, Blattella germanica
PKEASHLITVLPAAV

SEQ ID NO: 1355 - protein, 15 aa, Blattella germanica
HLITVLPAAVSDKNK

SEQ ID NO: 1356 - protein, 15 aa, Blattella germanica
AYLHFLFEMTKDPVF

SEQ ID NO: 1357 - protein, 15 aa, Blattella germanica
LFEMTKDPVFKNMTY

SEQ ID NO: 1358 - protein, 15 aa, Blattella germanica
KDPVFKNMTYVNTSL

SEQ ID NO: 1359 - protein, 15 aa, Blattella germanica
KNMTYVNTSLVLAFS

SEQ ID NO: 1360 - protein, 15 aa, Blattella germanica
VNTSLVLAFSEVIHQ

SEQ ID NO: 1361 - protein, 15 aa, Blattella germanica
VLAFSEVIHQVEMHQ

SEQ ID NO: 1362 - protein, 15 aa, Blattella germanica
EVIHQVEMHQVRDLK

SEQ ID NO: 1363 - protein, 15 aa, Blattella germanica
VEMHQVRDLKIKSVY

SEQ ID NO: 1364 - protein, 15 aa, Blattella germanica
VRDLKIKSVYIPYLV

SEQ ID NO: 1365 - protein, 15 aa, Blattella germanica
IKSVYIPYLVQEFDD

SEQ ID NO: 1366 - protein, 15 aa, Blattella germanica
QEFDDAVKENNSIKI

SEQ ID NO: 1367 - protein, 15 aa, Blattella germanica
AVKENNSIKIQLYTH

SEQ ID NO: 1368 - protein, 15 aa, Blattella germanica
NSIKIQLYTHALGVT

SEQ ID NO: 1369 - protein, 15 aa, Blattella germanica
QLYTHALGVTGNTHI

SEQ ID NO: 1370 - protein, 15 aa, Blattella germanica
ALGVTGNTHILHYLR

SEQ ID NO: 1371 - protein, 15 aa, Blattella germanica
GNTHILHYLRPYIIQ

SEQ ID NO: 1372 - protein, 15 aa, Blattella germanica
LHYLRPYIIQLKTIT

SEQ ID NO: 1373 - protein, 15 aa, Blattella germanica
PYIIQLKTITHHQRL

SEQ ID NO: 1374 - protein, 15 aa, Blattella germanica
LKTITHHQRLFMVQS

SEQ ID NO: 1375 - protein, 15 aa, Blattella germanica
HHQRLFMVQSLERVV

SEQ ID NO: 1376 - protein, 15 aa, Blattella germanica
FMVQSLERVVEHNPR

SEQ ID NO: 1377 - protein, 15 aa, Blattella germanica
LERVVEHNPRKVIDL

SEQ ID NO: 1378 - protein, 15 aa, Blattella germanica
KVIDLLLSLYLDQNE

SEQ ID NO: 1379 - protein, 15 aa, Blattella germanica
LLSLYLDQNEHADIR

SEQ ID NO: 1380 - protein, 15 aa, Blattella germanica
HADIRVEALFLLMKA

SEQ ID NO: 1381 - protein, 15 aa, Blattella germanica
VEALFLLMKADPSIH

SEQ ID NO: 1382 - protein, 15 aa, Blattella germanica
LLMKADPSIHVLKMV

SEQ ID NO: 1383 - protein, 15 aa, Blattella germanica
DPSIHVLKMVAELTH

SEQ ID NO: 1384 - protein, 15 aa, Blattella germanica
VLKMVAELTHTESNN

SEQ ID NO: 1385 - protein, 15 aa, Blattella germanica
QVLSASQSAIKSAAN

SEQ ID NO: 1386 - protein, 15 aa, Blattella germanica
YSEMRRKAKAVEHLL

SEQ ID NO: 1387 - protein, 15 aa, Blattella germanica
VEHLLSTRNMDVSYS

SEQ ID NO: 1388 - protein, 15 aa, Blattella germanica
STRNMDVSYSKSYLY

SEQ ID NO: 1389 - protein, 15 aa, Blattella germanica
DVSYSKSYLYGYKSK

SEQ ID NO: 1390 - protein, 15 aa, Blattella germanica
KSYLYGYKSKKINYD

SEQ ID NO: 1391 - protein, 15 aa, Blattella germanica
GYKSKKINYDSLYNL

SEQ ID NO: 1392 - protein, 15 aa, Blattella germanica
KINYDSLYNLNNIGS

SEQ ID NO: 1393 - protein, 15 aa, Blattella germanica
EDSIYPKSMLLNIFT

SEQ ID NO: 1394 - protein, 15 aa, Blattella germanica
PKSMLLNIFTNNLGR

SEQ ID NO: 1395 - protein, 15 aa, Blattella germanica
LNIFTNNLGRINTHV

SEQ ID NO: 1396 - protein, 15 aa, Blattella germanica
QKGYMVSSMTDLWEA

SEQ ID NO: 1397 - protein, 15 aa, Blattella germanica
DLWEAFHTIYKKDNG

SEQ ID NO: 1398 - protein, 15 aa, Blattella germanica
KTLVKFVEGNLKYFN

SEQ ID NO: 1399 - protein, 15 aa, Blattella germanica
LKYFNMGVQKFWAFD

SEQ ID NO: 1400 - protein, 15 aa, Blattella germanica
MGVQKFWAFDNTTFS

SEQ ID NO: 1401 - protein, 15 aa, Blattella germanica
FWAFDNTTFSNASAV

SEQ ID NO: 1402 - protein, 15 aa, Blattella germanica
NTTFSNASAVIQEFL

SEQ ID NO: 1403 - protein, 15 aa, Blattella germanica
NASAVIQEFLKTYKK

SEQ ID NO: 1404 - protein, 15 aa, Blattella germanica
IQEFLKTYKKPTNFN

SEQ ID NO: 1405 - protein, 15 aa, Blattella germanica
PTNFNHTKLSSSSSI

SEQ ID NO: 1406 - protein, 15 aa, Blattella germanica
HTKLSSSSSITLTLP

SEQ ID NO: 1407 - protein, 15 aa, Blattella germanica
SSSSITLTLPCAMGL

SEQ ID NO: 1408 - protein, 15 aa, Blattella germanica
PAYFKMNSPSLWKYN

SEQ ID NO: 1409 - protein, 15 aa, Blattella germanica
MNSPSLWKYNGEFSI

SEQ ID NO: 1410 - protein, 15 aa, Blattella germanica
GEFSIQTDAKTDVPM

SEQ ID NO: 1411 - protein, 15 aa, Blattella germanica
TDVPMSLENFMNITG

SEQ ID NO: 1412 - protein, 15 aa, Blattella germanica
SLENFMNITGSINLM

SEQ ID NO: 1413 - protein, 15 aa, Blattella germanica
MNITGSINLMFSQMY

SEQ ID NO: 1414 - protein, 15 aa, Blattella germanica
SINLMFSQMYHAQLA

SEQ ID NO: 1415 - protein, 15 aa, Blattella germanica
FSQMYHAQLAFSTAF

SEQ ID NO: 1416 - protein, 15 aa, Blattella germanica
RKVEVHVPVKFQINL

SEQ ID NO: 1417 - protein, 15 aa, Blattella germanica
HVPVKFQINLDFKNH

SEQ ID NO: 1418 - protein, 15 aa, Blattella germanica
FQINLDFKNHNGFIR

SEQ ID NO: 1419 - protein, 15 aa, Blattella germanica
DFKNHNGFIRIIPLF

SEQ ID NO: 1420 - protein, 15 aa, Blattella germanica
NGFIRIIPLFTDRDY

SEQ ID NO: 1421 - protein, 15 aa, Blattella germanica
DVLQWQTIPYTTIHN

SEQ ID NO: 1422 - protein, 15 aa, Blattella germanica
QTIPYTTIHNVPDFE

SEQ ID NO: 1423 - protein, 15 aa, Blattella germanica
RLFHTQPSITYQTLK

SEQ ID NO: 1424 - protein, 15 aa, Blattella germanica
VPDFETVYMDQLFKL

SEQ ID NO: 1425 - protein, 15 aa, Blattella germanica
YQTLKQSTWINYFKL

SEQ ID NO: 1426 - protein, 15 aa, Blattella germanica
TVYMDQLFKLIHVRK

SEQ ID NO: 1427 - protein, 15 aa, Blattella germanica
QSTWINYFKLIHVRK

SEQ ID NO: 1428 - protein, 15 aa, Blattella germanica
QLFKLIHVRKTAHFE

SEQ ID NO: 1429 - protein, 15 aa, Blattella germanica
NYFKLIHVRKTAHFE

SEQ ID NO: 1430 - protein, 15 aa, Blattella germanica
IHVRKTAHFEKKMGE

SEQ ID NO: 1431 - protein, 15 aa, Blattella germanica
NTGIVFKVKYDTDQE

SEQ ID NO: 1432 - protein, 15 aa, Blattella germanica
FKVKYDTDQEFLDTK

SEQ ID NO: 1433 - protein, 15 aa, Blattella germanica
FLDTKWFLDEFKVLQ

SEQ ID NO: 1434 - protein, 15 aa, Blattella germanica
WFLDEFKVLQLFTGL

SEQ ID NO: 1435 - protein, 15 aa, Blattella germanica
FKVLQLFTGLNYDVP

SEQ ID NO: 1436 - protein, 15 aa, Blattella germanica
TKDIFYNNLTVYYDH

SEQ ID NO: 1437 - protein, 15 aa, Blattella germanica
YIMIMKTPKTIAVSF

SEQ ID NO: 1438 - protein, 15 aa, Blattella germanica
QSKFYETLNPVVQQN

SEQ ID NO: 1439 - protein, 15 aa, Blattella germanica
ETLNPVVQQNLKLSS

SEQ ID NO: 1440 - protein, 15 aa, Blattella germanica
VVQQNLKLSSGKKQK

SEQ ID NO: 1441 - protein, 15 aa, Blattella germanica
HRNVKSHRIRREYTE

SEQ ID NO: 1442 - protein, 15 aa, Blattella germanica
PRRQEYLSKSMALTG

SEQ ID NO: 1443 - protein, 15 aa, Blattella germanica
YLSKSMALTGDATAV

SEQ ID NO: 1444 - protein, 15 aa, Blattella germanica
DATAVVLDMTLKFEG

SEQ ID NO: 1445 - protein, 15 aa, Blattella germanica
PAESYFTTTVSHATS

SEQ ID NO: 1446 - protein, 15 aa, Blattella germanica
FTTTVSHATSLVNGS

SEQ ID NO: 1447 - protein, 15 aa, Blattella germanica
SHATSLVNGSSNYLL

SEQ ID NO: 1448 - protein, 15 aa, Blattella germanica
LVNGSSNYLLFYDQH

SEQ ID NO: 1449 - protein, 15 aa, Blattella germanica
SNYLLFYDQHYYEEK

SEQ ID NO: 1450 - protein, 15 aa, Blattella germanica
KRNQFCLSWSVYKPQ

SEQ ID NO: 1451 - protein, 15 aa, Blattella germanica
CLSWSVYKPQVPIMN

SEQ ID NO: 1452 - protein, 15 aa, Blattella germanica
VYKPQVPIMNIYSAF

SEQ ID NO: 1453 - protein, 15 aa, Blattella germanica
VPIMNIYSAFEFDPN

SEQ ID NO: 1454 - protein, 15 aa, Blattella germanica
IYSAFEFDPNSKVHA

SEQ ID NO: 1455 - protein, 15 aa, Blattella germanica
SKVHAIMNIGKECEN

SEQ ID NO: 1456 - protein, 15 aa, Blattella germanica
GGSAVANIDMLRLSE

SEQ ID NO: 1457 - protein, 15 aa, Blattella germanica
ANIDMLRLSEHLDYV

SEQ ID NO: 1458 - protein, 15 aa, Blattella germanica
LRLSEHLDYVKNLTV

SEQ ID NO: 1459 - protein, 15 aa, Blattella germanica
HLDYVKNLTVSKLCD

SEQ ID NO: 1460 - protein, 15 aa, Blattella germanica
ASDLNRVHVDINYNL

SEQ ID NO: 1461 - protein, 15 aa, Blattella germanica
RVHVDINYNLKQHET

SEQ ID NO: 1462 - protein, 15 aa, Blattella germanica
FKRRVYKVYDFVRTH

SEQ ID NO: 1463 - protein, 15 aa, Blattella germanica
YKVYDFVRTHLYPHV

SEQ ID NO: 1464 - protein, 15 aa, Blattella germanica
FVRTHLYPHVSEDVI

SEQ ID NO: 1465 - protein, 15 aa, Blattella germanica
SEDVIVDNPAQFISA

SEQ ID NO: 1466 - protein, 15 aa, Blattella germanica
VDNPAQFISANFTLK

SEQ ID NO: 1467 - protein, 15 aa, Blattella germanica
QFISANFTLKDNTRA

SEQ ID NO: 1468 - protein, 15 aa, Blattella germanica
NFTLKDNTRAFNVSI

SEQ ID NO: 1469 - protein, 15 aa, Blattella germanica
DNTRAFNVSIKTPVL

SEQ ID NO: 1470 - protein, 15 aa, Blattella germanica
FNVSIKTPVLSVNAT

SEQ ID NO: 1471 - protein, 15 aa, Blattella germanica
KTPVLSVNATVVRLQ

SEQ ID NO: 1472 - protein, 15 aa, Blattella germanica
ETPVLSVNATSVRLQ

SEQ ID NO: 1473 - protein, 15 aa, Blattella germanica
SVNATVVRLQSWQSE

SEQ ID NO: 1474 - protein, 15 aa, Blattella germanica
VVRLQSWQSEMLRMN

SEQ ID NO: 1475 - protein, 15 aa, Blattella germanica
SWQSEMLRMNPRTSF

SEQ ID NO: 1476 - protein, 15 aa, Blattella germanica
MLRMNPRTSFAKRFA

SEQ ID NO: 1477 - protein, 15 aa, Blattella germanica
AKRFAKWALPLYNKP

SEQ ID NO: 1478 - protein, 15 aa, Blattella germanica
SSYINTFDNFTYSAH

SEQ ID NO: 1479 - protein, 15 aa, Blattella germanica
TFDNFTYSAHHIVQN

SEQ ID NO: 1480 - protein, 15 aa, Blattella germanica
TYSAHHIVQNDAFYT

SEQ ID NO: 1481 - protein, 15 aa, Blattella germanica
HIVQNDAFYTILDIP

SEQ ID NO: 1482 - protein, 15 aa, Blattella germanica
DAFYTILDIPQKFNM

SEQ ID NO: 1483 - protein, 15 aa, Blattella germanica
QKFNMEYFKVAFKPT

SEQ ID NO: 1484 - protein, 15 aa, Blattella germanica
EYFKVAFKPTSPVPN

SEQ ID NO: 1485 - protein, 15 aa, Blattella germanica
MQREVLVFLRNAKIE

SEQ ID NO: 1486 - protein, 15 aa, Blattella germanica
LVFLRNAKIELKPNQ

SEQ ID NO: 1487 - protein, 15 aa, Blattella germanica
DLNVSQDRIGYVYAF

SEQ ID NO: 1488 - protein, 15 aa, Blattella germanica
QDRIGYVYALPTKAA

SEQ ID NO: 1489 - protein, 15 aa, Blattella germanica
YVYALPTKAAHIVFP

SEQ ID NO: 1490 - protein, 15 aa, Blattella germanica
HIVFPSYEIEMFYDG

SEQ ID NO: 1491 - protein, 15 aa, Blattella germanica
SYEIEMFYDGSRIMI

SEQ ID NO: 1492 - protein, 15 aa, Blattella germanica
MFYDGSRIMIQASNM

SEQ ID NO: 1493 - protein, 15 aa, Blattella germanica
SRIMIQASNMYRNFT

SEQ ID NO: 1494 - protein, 15 aa, Blattella germanica
QASNMYRNFTKGLLW

SEQ ID NO: 1495 - protein, 15 aa, Blattella germanica
LTPWGCYAKDMALFV

SEQ ID NO: 1496 - protein, 15 aa, Blattella germanica
CYAKDMALFVASYAD

SEQ ID NO: 1497 - protein, 15 aa, Blattella germanica
MALFVASYADNSNSE

SEQ ID NO: 1498 - protein, 15 aa, Blattella germanica
LVSHQMRLSQVIKLA

SEQ ID NO: 1499 - protein, 15 aa, Blattella germanica
GVLVFTKENFKKGVS

SEQ ID NO: 1500 - protein, 15 aa, Blattella germanica
DNEFVLVEFYAPWCG

SEQ ID NO: 1501 - protein, 15 aa, Blattella germanica
PTLKFFRSGSPIDYS

SEQ ID NO: 1502 - protein, 15 aa, Blattella germanica
DEIVSWLLKKTGPVA

SEQ ID NO: 1503 - protein, 15 aa, Blattella germanica
VDDAKSFIDASNVAI

SEQ ID NO: 1504 - protein, 15 aa, Blattella germanica
SFIDASNVAIIGFFK

SEQ ID NO: 1505 - protein, 15 aa, Blattella germanica
AAKNFLAAANAIDDY

SEQ ID NO: 1506 - protein, 15 aa, Blattella germanica
PQIEVTFEIDANGIL

SEQ ID NO: 1507 - protein, 15 aa, Blattella germanica
TFEIDANGILQVSAE

SEQ ID NO: 1508 - protein, 15 aa, Blattella germanica
LESYAYSLKNQLADK

SEQ ID NO: 1509 - protein, 15 aa, Blattella germanica
KKELEDIVQPIIAKL

SEQ ID NO: 1510 - protein, 15 aa, Blattella germanica
DIVQPIIAKLYQGAG

SEQ ID NO: 1511 - protein, 15 aa, Blattella germanica
LELGALLTAMAMVTA

SEQ ID NO: 1512 - protein, 15 aa, Blattella germanica
LLTAMAMVTAKLATV

SEQ ID NO: 1513 - protein, 15 aa, Blattella germanica
STDSTLVYKIQPVNN

SEQ ID NO: 1514 - protein, 15 aa, Blattella germanica
LVYKIQPVNNAHGGG

SEQ ID NO: 1515 - protein, 15 aa, Blattella germanica
ASYFKSNCPDAYSYA

SEQ ID NO: 1516 - protein, 15 aa, Blattella germanica
SSLEVFFQQQRILLR

SEQ ID NO: 1517 - protein, 15 aa, Blattella germanica
FFQQQRILLRLHRCF

SEQ ID NO: 1518 - protein, 15 aa, Blattella germanica
RILLRLHRCFQVLGR

SEQ ID NO: 1519 - protein, 15 aa, Blattella germanica
WGGDVAFVKHLTALE

SEQ ID NO: 1520 - protein, 15 aa, Blattella germanica
AFVKHLTALENTDGH

SEQ ID NO: 1521 - protein, 15 aa, Blattella germanica
NQLNEIRHAILAAGD

SEQ ID NO: 1522 - protein, 15 aa, Blattella germanica
IRHAILAAGDLYSRR

SEQ ID NO: 1523 - protein, 15 aa, Blattella germanica
DGTKDLLFKNSATGL

SEQ ID NO: 1524 - protein, 15 aa, Blattella germanica
KDLLFKNSATGLLSV

SEQ ID NO: 1525 - protein, 15 aa, Blattella germanica
KHCLQMASNTMPYQI

SEQ ID NO: 1526 - protein, 15 aa, Blattella germanica
MPYQIASGFSTSQLA

SEQ ID NO: 1527 - protein, 15 aa, Blattella germanica
ASGFSTSQLAMIQNA

SEQ ID NO: 1528 - protein, 15 aa, Blattella germanica
TSQLAMIQNAIDEYH

SEQ ID NO: 1529 - protein, 15 aa, Blattella germanica
ERDDYVTIHWENIQS

SEQ ID NO: 1530 - protein, 15 aa, Blattella germanica
YGKIIKRLEAKGFKL

SEQ ID NO: 1531 - protein, 15 aa, Blattella germanica
KGFKLVAMKFVWADE

SEQ ID NO: 1532 - protein, 15 aa, Blattella germanica
VAMKFVWADEELLKK

SEQ ID NO: 1533 - protein, 15 aa, Blattella germanica
FPGLVKYMSSGPVVP

SEQ ID NO: 1534 - protein, 15 aa, Blattella germanica
MVWEGLNVVKTGRLM

SEQ ID NO: 1535 - protein, 15 aa, Blattella germanica
LNVVKTGRLMLGATD

SEQ ID NO: 1536 - protein, 15 aa, Blattella germanica
STRMELQHLQSIEVF

SEQ ID NO: 1537 - protein, 15 aa, Blattella germanica
LQHLQSIEVFPEDEG

SEQ ID NO: 1538 - protein, 15 aa, Blattella germanica
ILSCRIIGAQKFDVV

SEQ ID NO: 1539 - protein, 15 aa, Blattella germanica
SKDFQYTNEANIYKL

SEQ ID NO: 1540 - protein, 15 aa, Blattella germanica
YTNEANIYKLNIAEI

SEQ ID NO: 1541 - protein, 15 aa, Blattella germanica
NIYKLNIAEIFPEDS

SEQ ID NO: 1542 - protein, 15 aa, Blattella germanica
LILATAALAVAYPSP

SEQ ID NO: 1543 - protein, 15 aa, Blattella germanica
ILATAALAVAYPSPG

SEQ ID NO: 1544 - protein, 15 aa, Blattella germanica
QDYKVLADKTYLTRQ

SEQ ID NO: 1545 - protein, 15 aa, Blattella germanica
LADKTYLTRQRDLLK

SEQ ID NO: 1546 - protein, 15 aa, Blattella germanica
YLTRQRDLLKLLVRI

SEQ ID NO: 1547 - protein, 15 aa, Blattella germanica
RDLLKLLVRIQQPNY

SEQ ID NO: 1548 - protein, 15 aa, Blattella germanica
LLVRIQQPNYYADQY

SEQ ID NO: 1549 - protein, 15 aa, Blattella germanica
YADQYEIGQSYDIEA

SEQ ID NO: 1550 - protein, 15 aa, Blattella germanica
YDIEANINNYKYPYV

SEQ ID NO: 1551 - protein, 15 aa, Blattella germanica
NINNYKYPYVVKNFV

SEQ ID NO: 1552 - protein, 15 aa, Blattella germanica
KYPYVVKNFVAAYKN

SEQ ID NO: 1553 - protein, 15 aa, Blattella germanica
VKNFVAAYKNGMLAR

SEQ ID NO: 1554 - protein, 15 aa, Blattella germanica
PYYTTQSYETKLLFD

SEQ ID NO: 1555 - protein, 15 aa, Blattella germanica
QSYETKLLFDLFYYA

SEQ ID NO: 1556 - protein, 15 aa, Blattella germanica
KLLFDLFYYANDYDT

SEQ ID NO: 1557 - protein, 15 aa, Blattella germanica
LFYYANDYDTFYKTA

SEQ ID NO: 1558 - protein, 15 aa, Blattella germanica
HINEGQFLYALSSAL

SEQ ID NO: 1559 - protein, 15 aa, Blattella germanica
QFLYALSSALFQRED

SEQ ID NO: 1560 - protein, 15 aa, Blattella germanica
LNDYILPAPYEIYPW

SEQ ID NO: 1561 - protein, 15 aa, Blattella germanica
EIYPWLFVDSDVIQR

SEQ ID NO: 1562 - protein, 15 aa, Blattella germanica
LFVDSDVIQRAYETR

SEQ ID NO: 1563 - protein, 15 aa, Blattella germanica
DVIQRAYETRMSDVH

SEQ ID NO: 1564 - protein, 15 aa, Blattella germanica
MSDVHLTAPKTYIFP

SEQ ID NO: 1565 - protein, 15 aa, Blattella germanica
LTAPKTYIFPVNYTV

SEQ ID NO: 1566 - protein, 15 aa, Blattella germanica
TYIFPVNYTVHTPEQ

SEQ ID NO: 1567 - protein, 15 aa, Blattella germanica
ELNYFYHDVGLNTYY

SEQ ID NO: 1568 - protein, 15 aa, Blattella germanica
YHDVGLNTYYSYYYF

SEQ ID NO: 1569 - protein, 15 aa, Blattella germanica
LNTYYSYYYFNYPTF

SEQ ID NO: 1570 - protein, 15 aa, Blattella germanica
SYYYFNYPTFFNSTE

SEQ ID NO: 1571 - protein, 15 aa, Blattella germanica
NYPTFFNSTEYGVQF

SEQ ID NO: 1572 - protein, 15 aa, Blattella germanica
DRRGEMFYYTRQQLY

SEQ ID NO: 1573 - protein, 15 aa, Blattella germanica
PRHGEQFYYFYQQIY

SEQ ID NO: 1574 - protein, 15 aa, Blattella germanica
MFYYTRQQLYARYFL

SEQ ID NO: 1575 - protein, 15 aa, Blattella germanica
QFYYFYQQIYARYML

SEQ ID NO: 1576 - protein, 15 aa, Blattella germanica
RQQLYARYFLERLSN

SEQ ID NO: 1577 - protein, 15 aa, Blattella germanica
YQQIYARYMLERYSN

SEQ ID NO: 1578 - protein, 15 aa, Blattella germanica
ARYFLERLSNDLPDV

SEQ ID NO: 1579 - protein, 15 aa, Blattella germanica
EPLHYDRPFQTEYNP

SEQ ID NO: 1580 - protein, 15 aa, Blattella germanica
KPFTYNKAFKTPYNP

SEQ ID NO: 1581 - protein, 15 aa, Blattella germanica
DRPFQTEYNPQLRYP

SEQ ID NO: 1582 - protein, 15 aa, Blattella germanica
NKAFKTPYNPQLRYP

SEQ ID NO: 1583 - protein, 15 aa, Blattella germanica
PVRPYEYSRRSLYYS

SEQ ID NO: 1584 - protein, 15 aa, Blattella germanica
PARPAYMVPQDFDLY

SEQ ID NO: 1585 - protein, 15 aa, Blattella germanica
EYSRRSLYYSNGYSH

SEQ ID NO: 1586 - protein, 15 aa, Blattella germanica
SLYYSNGYSHYYGNY

SEQ ID NO: 1587 - protein, 15 aa, Blattella germanica
NYYTGDYHPSYYYGY

SEQ ID NO: 1588 - protein, 15 aa, Blattella germanica
DYHPSYYYGYATQYD

SEQ ID NO: 1589 - protein, 15 aa, Blattella germanica
YYYGYATQYDYYYPE

SEQ ID NO: 1590 - protein, 15 aa, Blattella germanica
ATQYDYYYPEDLQSY

SEQ ID NO: 1591 - protein, 15 aa, Blattella germanica
YYYPEDLQSYERRVR

SEQ ID NO: 1592 - protein, 15 aa, Blattella germanica
GYFFGFQGEKYPLYE

SEQ ID NO: 1593 - protein, 15 aa, Blattella germanica
FQGEKYPLYENYIKG

SEQ ID NO: 1594 - protein, 15 aa, Blattella germanica
YPLYENYIKGIDYLG

SEQ ID NO: 1595 - protein, 15 aa, Blattella germanica
NQRFYGSIYHYYRQL

SEQ ID NO: 1596 - protein, 15 aa, Blattella germanica
GSIYHYYRQLAGKSV

SEQ ID NO: 1597 - protein, 15 aa, Blattella germanica
YYRQLAGKSVDPYNN

SEQ ID NO: 1598 - protein, 15 aa, Blattella germanica
DPYNNYGLAPSALQN

SEQ ID NO: 1599 - protein, 15 aa, Blattella germanica
YGLAPSALQNIYTTL

SEQ ID NO: 1600 - protein, 15 aa, Blattella germanica
SALQNIYTTLRDPAN

SEQ ID NO: 1601 - protein, 15 aa, Blattella germanica
RDPANWQILKRVNYL

SEQ ID NO: 1602 - protein, 15 aa, Blattella germanica
WQILKRVNYLFQRYK

SEQ ID NO: 1603 - protein, 15 aa, Blattella germanica
RVNYLFQRYKGYLPR

SEQ ID NO: 1604 - protein, 15 aa, Blattella germanica
EHFDVDLDNVVNVKV

SEQ ID NO: 1605 - protein, 15 aa, Blattella germanica
AEDGKYIDYRARQTR

SEQ ID NO: 1606 - protein, 15 aa, Blattella germanica
YIDYRARQTRLNHKP

SEQ ID NO: 1607 - protein, 15 aa, Blattella germanica
QATDAYVRVFLGPKY

SEQ ID NO: 1608 - protein, 15 aa, Blattella germanica
YVRVFLGPKYDYLHS

SEQ ID NO: 1609 - protein, 15 aa, Blattella germanica
DRRHYFVEIDRFPYK

SEQ ID NO: 1610 - protein, 15 aa, Blattella germanica
FVEIDRFPYKVQAGK

SEQ ID NO: 1611 - protein, 15 aa, Blattella germanica
RFPYKVQAGKTTITR

SEQ ID NO: 1612 - protein, 15 aa, Blattella germanica
SVVSPDYQSYRTLMR

SEQ ID NO: 1613 - protein, 15 aa, Blattella germanica
DYQSYRTLMRKVYDA

SEQ ID NO: 1614 - protein, 15 aa, Blattella germanica
RTLMRKVYDAYEGKD

SEQ ID NO: 1615 - protein, 15 aa, Blattella germanica
YEGKDQFYYDKSEQY

SEQ ID NO: 1616 - protein, 15 aa, Blattella germanica
QFYYDKSEQYCGYPE

SEQ ID NO: 1617 - protein, 15 aa, Blattella germanica
GQEYTFYVIVTPYAK

SEQ ID NO: 1618 - protein, 15 aa, Blattella germanica
FYVIVTPYAKQDDHD

SEQ ID NO: 1619 - protein, 15 aa, Blattella germanica
YKSFSYCGVGANHRI

SEQ ID NO: 1620 - protein, 15 aa, Blattella germanica
SHDFVTPNMYFKDVV

SEQ ID NO: 1621 - protein, 15 aa, Blattella germanica
TPNMYFKDVVIYHKK

SEQ ID NO: 1622 - protein, 15 aa, Blattella germanica
FSNMDIKGKNALVTG

SEQ ID NO: 1623 - protein, 15 aa, Blattella germanica
AATGIGLEYVKQLLE

SEQ ID NO: 1624 - protein, 15 aa, Blattella germanica
GLEYVKQLLENGAQH

SEQ ID NO: 1625 - protein, 15 aa, Blattella germanica
KQLLENGAQHVAVCD

SEQ ID NO: 1626 - protein, 15 aa, Blattella germanica
KELVEKYGKGKAIFI

SEQ ID NO: 1627 - protein, 15 aa, Blattella germanica
KAIFIKCDVTNIPEF

SEQ ID NO: 1628 - protein, 15 aa, Blattella germanica
EDAFKKAYNAFKSLD

SEQ ID NO: 1629 - protein, 15 aa, Blattella germanica
KAYNAFKSLDIVINN

SEQ ID NO: 1630 - protein, 15 aa, Blattella germanica
FKSLDIVINNAGILN

SEQ ID NO: 1631 - protein, 15 aa, Blattella germanica
IVINNAGILNDEKWE

SEQ ID NO: 1632 - protein, 15 aa, Blattella germanica
DEKWELQIAINVNGV

SEQ ID NO: 1633 - protein, 15 aa, Blattella germanica
LQIAINVNGVVRGTL

SEQ ID NO: 1634 - protein, 15 aa, Blattella germanica
GGKGGVIVNIASILG

SEQ ID NO: 1635 - protein, 15 aa, Blattella germanica
VIVNIASILGLQNMA

SEQ ID NO: 1636 - protein, 15 aa, Blattella germanica
ASILGLQNMAGCPVY

SEQ ID NO: 1637 - protein, 15 aa, Blattella germanica
GCPVYVGTKHAVVGI

SEQ ID NO: 1638 - protein, 15 aa, Blattella germanica
AVVGISRSFGMPFHF

SEQ ID NO: 1639 - protein, 15 aa, Blattella germanica
MPFHFDRTGVRVLTM

SEQ ID NO: 1640 - protein, 15 aa, Blattella germanica
DRTGVRVLTMCPGVT

SEQ ID NO: 1641 - protein, 15 aa, Blattella germanica
AKGMMHMIKKGANGS

SEQ ID NO: 1642 - protein, 15 aa, Blattella germanica
GNKPVYEVAIPDRLT

SEQ ID NO: 1643 - protein, 15 aa, Blattella germanica
VYEVAIPDRLTLRVE

SEQ ID NO: 1644 - protein, 15 aa, Blattella germanica
AGVLWVCATGMARQV

SEQ ID NO: 1645 - protein, 15 aa, Blattella germanica
QTLFLLLLLLAAVSA

SEQ ID NO: 1646 - protein, 15 aa, Blattella germanica
LLLLLAAVSASQQCK

SEQ ID NO: 1647 - protein, 15 aa, Blattella germanica
AGNTYVYSFEGGTTT

SEQ ID NO: 1648 - protein, 15 aa, Blattella germanica
QGDGVKLHLKAKAEV

SEQ ID NO: 1649 - protein, 15 aa, Blattella germanica
THLNDLESHPVSFSF

SEQ ID NO: 1650 - protein, 15 aa, Blattella germanica
SEASLNLKRAILAHF

SEQ ID NO: 1651 - protein, 15 aa, Blattella germanica
NLKRAILAHFQVAPQ

SEQ ID NO: 1652 - protein, 15 aa, Blattella germanica
ILAHFQVAPQETARS

SEQ ID NO: 1653 - protein, 15 aa, Blattella germanica
RGGTTTITKSRNLNK

SEQ ID NO: 1654 - protein, 15 aa, Blattella germanica
CHLREHLRQDFASVT

SEQ ID NO: 1655 - protein, 15 aa, Blattella germanica
HLRQDFASVTYHVES

SEQ ID NO: 1656 - protein, 15 aa, Blattella germanica
FASVTYHVESDLQNS

SEQ ID NO: 1657 - protein, 15 aa, Blattella germanica
TQEFKHQLQGGVLRV

SEQ ID NO: 1658 - protein, 15 aa, Blattella germanica
KYLYRPFANQDAGAK

SEQ ID NO: 1659 - protein, 15 aa, Blattella germanica
DAGAKTVVDSKLTYV

SEQ ID NO: 1660 - protein, 15 aa, Blattella germanica
QSIIFHPPNVHPGSG

SEQ ID NO: 1661 - protein, 15 aa, Blattella germanica
KEFANVVRVVRHTSK

SEQ ID NO: 1662 - protein, 15 aa, Blattella germanica
VVRVVRHTSKNDLLS

SEQ ID NO: 1663 - protein, 15 aa, Blattella germanica
NDLLSVYNQVKSGAG

SEQ ID NO: 1664 - protein, 15 aa, Blattella germanica
FKDKSAGTKMFLDAL

SEQ ID NO: 1665 - protein, 15 aa, Blattella germanica
AGTKMFLDALFRAGT

SEQ ID NO: 1666 - protein, 15 aa, Blattella germanica
VAVELLKSNKITGPH

SEQ ID NO: 1667 - protein, 15 aa, Blattella germanica
AEFYYLQLAYTRHVT

SEQ ID NO: 1668 - protein, 15 aa, Blattella germanica
LQLAYTRHVTKAALL

SEQ ID NO: 1669 - protein, 15 aa, Blattella germanica
TRHVTKAALLAAVTL

SEQ ID NO: 1670 - protein, 15 aa, Blattella germanica
KAALLAAVTLLEQPN

SEQ ID NO: 1671 - protein, 15 aa, Blattella germanica
AAVTLLEQPNPSKLA

SEQ ID NO: 1672 - protein, 15 aa, Blattella germanica
AEVDEFLEKLSLLLN

SEQ ID NO: 1673 - protein, 15 aa, Blattella germanica
FLEKLSLLLNGGCKV

SEQ ID NO: 1674 - protein, 15 aa, Blattella germanica
SLLLNGGCKVSNYDE

SEQ ID NO: 1675 - protein, 15 aa, Blattella germanica
SNYDEEVKIVATLKA

SEQ ID NO: 1676 - protein, 15 aa, Blattella germanica
EVKIVATLKALQNAH

SEQ ID NO: 1677 - protein, 15 aa, Blattella germanica
ATLKALQNAHHLNDA

SEQ ID NO: 1678 - protein, 15 aa, Blattella germanica
HLNDAVTSKLQTCLL

SEQ ID NO: 1679 - protein, 15 aa, Blattella germanica
DDGVPTRIRSAVLDV

SEQ ID NO: 1680 - protein, 15 aa, Blattella germanica
CKAKDISLEVLKNYQ

SEQ ID NO: 1681 - protein, 15 aa, Blattella germanica
ISLEVLKNYQLDSEL

SEQ ID NO: 1682 - protein, 15 aa, Blattella germanica
LKNYQLDSELRIKAF

SEQ ID NO: 1683 - protein, 15 aa, Blattella germanica
LDSELRIKAFLALVE

SEQ ID NO: 1684 - protein, 15 aa, Blattella germanica
RIKAFLALVECPCNK

SEQ ID NO: 1685 - protein, 15 aa, Blattella germanica
KELLDKEPSYQVGSF

SEQ ID NO: 1686 - protein, 15 aa, Blattella germanica
KEPSYQVGSFIVSYL

SEQ ID NO: 1687 - protein, 15 aa, Blattella germanica
QVGSFIVSYLRNLRA

SEQ ID NO: 1688 - protein, 15 aa, Blattella germanica
IVSYLRNLRASANPS

SEQ ID NO: 1689 - protein, 15 aa, Blattella germanica
RNLRASANPSKEKQK

SEQ ID NO: 1690 - protein, 15 aa, Blattella germanica
AVFGEIRTTKRFPID

SEQ ID NO: 1691 - protein, 15 aa, Blattella germanica
IRTTKRFPIDFRKFS

SEQ ID NO: 1692 - protein, 15 aa, Blattella germanica
RFPIDFRKFSNNFEF

SEQ ID NO: 1693 - protein, 15 aa, Blattella germanica
FRKFSNNFEFSYLLG

SEQ ID NO: 1694 - protein, 15 aa, Blattella germanica
NNFEFSYLLGGANVG

SEQ ID NO: 1695 - protein, 15 aa, Blattella germanica
TTVESNVIYSQNSFL

SEQ ID NO: 1696 - protein, 15 aa, Blattella germanica
NVIYSQNSFLPRATT

SEQ ID NO: 1697 - protein, 15 aa, Blattella germanica
LNLTTEFFGHSVNLL

SEQ ID NO: 1698 - protein, 15 aa, Blattella germanica
EFFGHSVNLLEVELR

SEQ ID NO: 1699 - protein, 15 aa, Blattella germanica
GYFNTHTAAEVVQKG

SEQ ID NO: 1700 - protein, 15 aa, Blattella germanica
DVENTAKQRFNHAIR

SEQ ID NO: 1701 - protein, 15 aa, Blattella germanica
AKQRFNHAIRGKRSV

SEQ ID NO: 1702 - protein, 15 aa, Blattella germanica
NHAIRGKRSVTKEQL

SEQ ID NO: 1703 - protein, 15 aa, Blattella germanica
TKEQLELVKSKSVSP

SEQ ID NO: 1704 - protein, 15 aa, Blattella germanica
ELVKSKSVSPYHSET

SEQ ID NO: 1705 - protein, 15 aa, Blattella germanica
DRELLLELSTRLFGA

SEQ ID NO: 1706 - protein, 15 aa, Blattella germanica
RLFGAEVGWLALHHN

SEQ ID NO: 1707 - protein, 15 aa, Blattella germanica
EVGWLALHHNARDAA

SEQ ID NO: 1708 - protein, 15 aa, Blattella germanica
TTFNLLDKVMKKAKD

SEQ ID NO: 1709 - protein, 15 aa, Blattella germanica
FDYKLRQHNTFLDTE

SEQ ID NO: 1710 - protein, 15 aa, Blattella germanica
FLDTELVYPTSLGFP

SEQ ID NO: 1711 - protein, 15 aa, Blattella germanica
LVYPTSLGFPLKLVL

SEQ ID NO: 1712 - protein, 15 aa, Blattella germanica
SLGFPLKLVLAGSSA

SEQ ID NO: 1713 - protein, 15 aa, Blattella germanica
LKLVLAGSSAVHVEL

SEQ ID NO: 1714 - protein, 15 aa, Blattella germanica
VHDLVHNLKNSHVHF

SEQ ID NO: 1715 - protein, 15 aa, Blattella germanica
HNLKNSHVHFRFVPS

SEQ ID NO: 1716 - protein, 15 aa, Blattella germanica
SHVHFRFVPSAAVEF

SEQ ID NO: 1717 - protein, 15 aa, Blattella germanica
RFVPSAAVEFVGAFV

SEQ ID NO: 1718 - protein, 15 aa, Blattella germanica
AAVEFVGAFVVDAYA

SEQ ID NO: 1719 - protein, 15 aa, Blattella germanica
VGAFVVDAYAVEAGL

SEQ ID NO: 1720 - protein, 15 aa, Blattella germanica
VDAYAVEAGLKVAAT

SEQ ID NO: 1721 - protein, 15 aa, Blattella germanica
VEAGLKVAATLHTAT

SEQ ID NO: 1722 - protein, 15 aa, Blattella germanica
KVAATLHTATGSDIT

SEQ ID NO: 1723 - protein, 15 aa, Blattella germanica
DVGVDVTVGLPVQKQ

SEQ ID NO: 1724 - protein, 15 aa, Blattella germanica
PVQKQDIVTLKTEVL

SEQ ID NO: 1725 - protein, 15 aa, Blattella germanica
DIVTLKTEVLTTVQE

SEQ ID NO: 1726 - protein, 15 aa, Blattella germanica
HGCFDQLSPLVGLTF

SEQ ID NO: 1727 - protein, 15 aa, Blattella germanica
VGLTFCTTMSFPWDP

SEQ ID NO: 1728 - protein, 15 aa, Blattella germanica
FPWDPVASKAAFYPL

SEQ ID NO: 1729 - protein, 15 aa, Blattella germanica
AFYPLNGPSKFSLVV

SEQ ID NO: 1730 - protein, 15 aa, Blattella germanica
TSYHFRASLNKADPH

SEQ ID NO: 1731 - protein, 15 aa, Blattella germanica
KKSLELLLETPGSKT

SEQ ID NO: 1732 - protein, 15 aa, Blattella germanica
ERKLGLILERTYDPY

SEQ ID NO: 1733 - protein, 15 aa, Blattella germanica
TYDPYHGVKAQLNSP

SEQ ID NO: 1734 - protein, 15 aa, Blattella germanica
HGVKAQLNSPWKQVS

SEQ ID NO: 1735 - protein, 15 aa, Blattella germanica
QLNSPWKQVSAELAF

SEQ ID NO: 1736 - protein, 15 aa, Blattella germanica
DEQEYYVKLGASVTG

SEQ ID NO: 1737 - protein, 15 aa, Blattella germanica
THQFNVAGSVTVDKT

SEQ ID NO: 1738 - protein, 15 aa, Blattella germanica
TDLKVYYGENHVVLK

SEQ ID NO: 1739 - protein, 15 aa, Blattella germanica
YYGENHVVLKSGFKR

SEQ ID NO: 1740 - protein, 15 aa, Blattella germanica
HVVLKSGFKRPSANN

SEQ ID NO: 1741 - protein, 15 aa, Blattella germanica
QYPDFGVNLIWNHKR

SEQ ID NO: 1742 - protein, 15 aa, Blattella germanica
GVNLIWNHKRDKNNF

SEQ ID NO: 1743 - protein, 15 aa, Blattella germanica
DKNNFGNSLAVVHGR

SEQ ID NO: 1744 - protein, 15 aa, Blattella germanica
EARFTLNQEAHYQFD

SEQ ID NO: 1745 - protein, 15 aa, Blattella germanica
LNQEAHYQFDSIHKF

SEQ ID NO: 1746 - protein, 15 aa, Blattella germanica
HYQFDSIHKFEFASK

SEQ ID NO: 1747 - protein, 15 aa, Blattella germanica
SIHKFEFASKNKVTY

SEQ ID NO: 1748 - protein, 15 aa, Blattella germanica
EFASKNKVTYPLLGI

SEQ ID NO: 1749 - protein, 15 aa, Blattella germanica
PLLGIIGKLDASVQP

SEQ ID NO: 1750 - protein, 15 aa, Blattella germanica
KTFHLDVEASYEKHK

SEQ ID NO: 1751 - protein, 15 aa, Blattella germanica
RVIVSEGKSKFTTEL

SEQ ID NO: 1752 - protein, 15 aa, Blattella germanica
NNIDFQIDAEAKIHG

SEQ ID NO: 1753 - protein, 15 aa, Blattella germanica
QPDPYKLDSGLVYNP

SEQ ID NO: 1754 - protein, 15 aa, Blattella germanica
KLDSGLVYNPQLFDA

SEQ ID NO: 1755 - protein, 15 aa, Blattella germanica
KVFLKNYLVGNAQFK

SEQ ID NO: 1756 - protein, 15 aa, Blattella germanica
NYLVGNAQFKYTNGE

SEQ ID NO: 1757 - protein, 15 aa, Blattella germanica
GSATLNVDVPKLGRK

SEQ ID NO: 1758 - protein, 15 aa, Blattella germanica
DLHVKGSQHVATVEL

SEQ ID NO: 1759 - protein, 15 aa, Blattella germanica
GSQHVATVELYYNAE

SEQ ID NO: 1760 - protein, 15 aa, Blattella germanica
ATVELYYNAEKKLAF

SEQ ID NO: 1761 - protein, 15 aa, Blattella germanica
YYNAEKKLAFHTDTD

SEQ ID NO: 1762 - protein, 15 aa, Blattella germanica
KKLAFHTDTDLKKDS

SEQ ID NO: 1763 - protein, 15 aa, Blattella germanica
LDSKNVLSILNYKTE

SEQ ID NO: 1764 - protein, 15 aa, Blattella germanica
VLSILNYKTEVNVKG

SEQ ID NO: 1765 - protein, 15 aa, Blattella germanica
YTGPFSVDNVLEFKL

SEQ ID NO: 1766 - protein, 15 aa, Blattella germanica
KKLQFTYSESLDLDD

SEQ ID NO: 1767 - protein, 15 aa, Blattella germanica
SSGKASYESFQNFRV

SEQ ID NO: 1768 - protein, 15 aa, Blattella germanica
SYESFQNFRVEADIE

SEQ ID NO: 1769 - protein, 15 aa, Blattella germanica
LKKWHVLLANKPQAK

SEQ ID NO: 1770 - protein, 15 aa, Blattella germanica
LKADVFFNKFNPTDN

SEQ ID NO: 1771 - protein, 15 aa, Blattella germanica
RQPLSFDHAVELKLL

SEQ ID NO: 1772 - protein, 15 aa, Blattella germanica
TYNFHSYLNEKALGV

SEQ ID NO: 1773 - protein, 15 aa, Blattella germanica
KALGVILTLPQRIIA

SEQ ID NO: 1774 - protein, 15 aa, Blattella germanica
KAAVHLLVAVKASKE

SEQ ID NO: 1775 - protein, 15 aa, Blattella germanica
DGASYISTLAYQDEK

SEQ ID NO: 1776 - protein, 15 aa, Blattella germanica
AQIQVVIHLDEQYIY

SEQ ID NO: 1777 - protein, 15 aa, Blattella germanica
EQYIYVKSPTAELIK

SEQ ID NO: 1778 - protein, 15 aa, Blattella germanica
SKAVYYKKILPTRSS

SEQ ID NO: 1779 - protein, 15 aa, Blattella germanica
YKKILPTRSSPLISC

SEQ ID NO: 1780 - protein, 15 aa, Blattella germanica
IESIRKQTAIEIEQL

SEQ ID NO: 1781 - protein, 15 aa, Blattella germanica
KQTAIEIEQLNARVV

SEQ ID NO: 1782 - protein, 15 aa, Blattella germanica
KLQIQITELEMSLDV

SEQ ID NO: 1783 - protein, 15 aa, Blattella germanica
TIKKQSLTLTEIQAH

SEQ ID NO: 1784 - protein, 15 aa, Blattella germanica
GIAQRKLQSVTAELE

SEQ ID NO: 1785 - protein, 15 aa, Blattella germanica
RVNELTTINVNLASA

SEQ ID NO: 1786 - protein, 15 aa, Blattella germanica
TTINVNLASAKSKVE

SEQ ID NO: 1787 - protein, 15 aa, Blattella germanica
EQERIVKIEAIKKSL

SEQ ID NO: 1788 - protein, 15 aa, Blattella germanica
LSLIRAKHRTFVTTS

SEQ ID NO: 1789 - protein, 15 aa, Blattella germanica
PQKFKVVFDTGSSNL

SEQ ID NO: 1790 - protein, 15 aa, Blattella germanica
VVFDTGSSNLWVPSK

SEQ ID NO: 1791 - protein, 15 aa, Blattella germanica
WVPSKKCHLTNIACL

SEQ ID NO: 1792 - protein, 15 aa, Blattella germanica
KCHLTNIACLLHNKY

SEQ ID NO: 1793 - protein, 15 aa, Blattella germanica
NIACLLHNKYDSTKS

SEQ ID NO: 1794 - protein, 15 aa, Blattella germanica
NGTSFAIQYGSGSLS

SEQ ID NO: 1795 - protein, 15 aa, Blattella germanica
SGSLSGFLSTDVLDI

SEQ ID NO: 1796 - protein, 15 aa, Blattella germanica
GFLSTDVLDIGGLKV

SEQ ID NO: 1797 - protein, 15 aa, Blattella germanica
DVLDIGGLKVQKQTF

SEQ ID NO: 1798 - protein, 15 aa, Blattella germanica
EPGLAFVAAKFDGIL

SEQ ID NO: 1799 - protein, 15 aa, Blattella germanica
FVAAKFDGILGMAYS

SEQ ID NO: 1800 - protein, 15 aa, Blattella germanica
FDGILGMAYSTISVD

SEQ ID NO: 1801 - protein, 15 aa, Blattella germanica
TISVDGVTPVFYNMV

SEQ ID NO: 1802 - protein, 15 aa, Blattella germanica
GVTPVFYNMVKQGLV

SEQ ID NO: 1803 - protein, 15 aa, Blattella germanica
FYNMVKQGLVSQPIF

SEQ ID NO: 1804 - protein, 15 aa, Blattella germanica
KQGLVSQPIFSFYLS

SEQ ID NO: 1805 - protein, 15 aa, Blattella germanica
SQPIFSFYLSRDPGA

SEQ ID NO: 1806 - protein, 15 aa, Blattella germanica
SDPNHYKGDFTYLSV

SEQ ID NO: 1807 - protein, 15 aa, Blattella germanica
YKGDFTYLSVDRKMY

SEQ ID NO: 1808 - protein, 15 aa, Blattella germanica
TYLSVDRKMYWQFKM

SEQ ID NO: 1809 - protein, 15 aa, Blattella germanica
DRKMYWQFKMDKIQI

SEQ ID NO: 1810 - protein, 15 aa, Blattella germanica
WQFKMDKIQIGNGSF

SEQ ID NO: 1811 - protein, 15 aa, Blattella germanica
IAGPVSEVTALNRQI

SEQ ID NO: 1812 - protein, 15 aa, Blattella germanica
SEVTALNRQIGGTPI

SEQ ID NO: 1813 - protein, 15 aa, Blattella germanica
ILGGKKFTLEGKDYI

SEQ ID NO: 1814 - protein, 15 aa, Blattella germanica
KFTLEGKDYILRVSQ

SEQ ID NO: 1815 - protein, 15 aa, Blattella germanica
GKDYILRVSQLGHTV

SEQ ID NO: 1816 - protein, 15 aa, Blattella germanica
LGHTVCLSGFMGIDL

SEQ ID NO: 1817 - protein, 15 aa, Blattella germanica
CLSGFMGIDLPKGPL

SEQ ID NO: 1818 - protein, 15 aa, Blattella germanica
WILGDVFIGKFYTEF

SEQ ID NO: 1819 - protein, 15 aa, Blattella germanica
VFIGKFYTEFDMENN

SEQ ID NO: 1820 - protein, 15 aa, Blattella germanica
FYTEFDMENNRVGFA

SEQ ID NO: 1821 - protein, 15 aa, Blattella germanica
AGEKVRIIIDRFMDF

SEQ ID NO: 1822 - protein, 15 aa, Blattella germanica
RIIIDRFMDFREQEK

SEQ ID NO: 1823 - protein, 15 aa, Blattella germanica
VPPELVVVFDVRLAV

SEQ ID NO: 1824 - protein, 15 aa, Blattella germanica
VVVFDVRLAVTVDHA

SEQ ID NO: 1825 - protein, 15 aa, Blattella germanica
HDEFLNEDIFLKGID

SEQ ID NO: 1826 - protein, 15 aa, Blattella germanica
NEDIFLKGIDIFCQI

SEQ ID NO: 1827 - protein, 15 aa, Blattella germanica
LKGIDIFCQIIPAVA

SEQ ID NO: 1828 - protein, 15 aa, Blattella germanica
IFCQIIPAVANVAPP

SEQ ID NO: 1829 - protein, 15 aa, Blattella germanica
TLGEAISSSTLRVFA

SEQ ID NO: 1830 - protein, 15 aa, Blattella germanica
NIREGGFAHFEARLE

SEQ ID NO: 1831 - protein, 15 aa, Blattella germanica
SSRITTFFNFGYVAL

SEQ ID NO: 1832 - protein, 15 aa, Blattella germanica
TFFNFGYVALTIKHV

SEQ ID NO: 1833 - protein, 15 aa, Blattella germanica
GYVALTIKHVTTHDI

SEQ ID NO: 1834 - protein, 15 aa, Blattella germanica
TIPYYTKKFDEVVKA

SEQ ID NO: 1835 - protein, 15 aa, Blattella germanica
ISDFRAAIANYHYDA

SEQ ID NO: 1836 - protein, 15 aa, Blattella germanica
YFVAILDYLNHMAKE

SEQ ID NO: 1837 - protein, 15 aa, Blattella germanica
VAISRYLGKQFGLSG

SEQ ID NO: 1838 - protein, 15 aa, Blattella germanica
MIVDTISDFRAAIAN

SEQ ID NO: 1839 - protein, 15 aa, Blattella germanica
DLVANQPNLKALREK

SEQ ID NO: 1840 - protein, 15 aa, Blattella germanica
HDDRLGFLTFCPTNL

SEQ ID NO: 1841 - protein, 15 aa, Blattella germanica
KNRTTIRGRTKFEGN

SEQ ID NO: 1842 - protein, 15 aa, Blattella germanica
DRKMYWQFKMDKIQI

SEQ ID NO: 1843 - protein, 15 aa, Blattella germanica
ALREKVLGLPAIKAW

SEQ ID NO: 1844 - protein, 15 aa, Blattella germanica
IRGRTKFEGNKFTID

SEQ ID NO: 1845 - protein, 15 aa, Blattella germanica
NDIEKRVPFSHDDRL

SEQ ID NO: 1846 - protein, 15 aa, Blattella germanica
HMAKEDLVANQPNLK

SEQ ID NO: 1847 - protein, 15 aa, Blattella germanica
VLEKLEAGFAKLAAS

SEQ ID NO: 1848 - protein, 15 aa, Blattella germanica
NYAIVEGCPAAANGH

SEQ ID NO: 1849 - protein, 15 aa, Blattella germanica
GIRIYVDVVLNQMSG

SEQ ID NO: 1850 - protein, 15 aa, Blattella germanica
RWRQIFNMVGFRNAV

SEQ ID NO: 1851 - protein, 15 aa, Blattella germanica
NIACLLHNKYDSTKS

SEQ ID NO: 1852 - protein, 15 aa, Blattella germanica
NGGYLAAGKLTWADF

SEQ ID NO: 1853 - protein, 15 aa, Blattella germanica
LNIFTNNLGRINTHV

SEQ ID NO: 1854 - protein, 15 aa, Blattella germanica
KTPVLEIDGKQTHQS

SEQ ID NO: 1855 - protein, 15 aa, Blattella germanica
PAYFKMNSPSLWKYN

SEQ ID NO: 1856 - protein, 15 aa, Blattella germanica
PKSMLLNIFTNNLGR

SEQ ID NO: 1857 - protein, 15 aa, Blattella germanica
FQINLDFKNHNGFIR

SEQ ID NO: 1858 - protein, 15 aa, Blattella germanica
SSLFQVANQYTGILY

SEQ ID NO: 1859 - protein, 15 aa, Blattella germanica
VLGLPAIKAWVAKRP

SEQ ID NO: 1860 - protein, 15 aa, Blattella germanica
QVYRRLVTAVNDIEK

SEQ ID NO: 1861 - protein, 15 aa, Blattella germanica
RHNSAYKLHFNAFEY

SEQ ID NO: 1862 - protein, 15 aa, Blattella germanica
KLAASDSKSLLRKYL

SEQ ID NO: 1863 - protein, 15 aa, Blattella germanica
RLFGAEVGWLALHHN

SEQ ID NO: 1864 - protein, 15 aa, Blattella germanica
RVPFSHDDRLGFLTF

SEQ ID NO: 1865 - protein, 15 aa, Blattella germanica
WVCEHRWRQIFNMVG

SEQ ID NO: 1866 - protein, 15 aa, Blattella germanica
ATDYENYAIVEGCPA

SEQ ID NO: 1867 - protein, 15 aa, Blattella germanica
KFTIDYNDKGKAFSA

SEQ ID NO: 1868 - protein, 15 aa, Blattella germanica
AAIANYHYDADENSK

SEQ ID NO: 1869 - protein, 15 aa, Blattella germanica
FGSTLLDVIQSGLEN

SEQ ID NO: 1870 - protein, 15 aa, Blattella germanica
HYQFDSIHKFEFASK

SEQ ID NO: 1871 - protein, 15 aa, Blattella germanica
TKKFDEVVKANGGYL

SEQ ID NO: 1872 - protein, 15 aa, Blattella germanica
YLGKQFGLSGKDDWE

SEQ ID NO: 1873 - protein, 15 aa, Blattella germanica
LNQEAHYQFDSIHKF

SEQ ID NO: 1874 - protein, 15 aa, Blattella germanica
KCHLTNIACLLHNKY

SEQ ID NO: 1875 - protein, 15 aa, Blattella germanica
GVTPVFYNMVKQGLV

SEQ ID NO: 1876 - protein, 15 aa, Blattella germanica
RCGRSMQGYPFNPCL

SEQ ID NO: 1877 - protein, 15 aa, Blattella germanica
STSLVKAHSMRNSAS

SEQ ID NO: 1878 - protein, 15 aa, Blattella germanica
LKYFNMGVQKFWAFD

SEQ ID NO: 1879 - protein, 15 aa, Blattella germanica
GASILTYKTSKLYKM

SEQ ID NO: 1880 - protein, 15 aa, Blattella germanica
NLEIDMIVDTISDFR

SEQ ID NO: 1881 - protein, 15 aa, Blattella germanica
AKGMMHMIKKGANGS

SEQ ID NO: 1882 - protein, 15 aa, Blattella germanica
PAIKAWVAKRPPTDL

SEQ ID NO: 1883 - protein, 15 aa, Blattella germanica
VPIMNIYSAFEFDPN

SEQ ID NO: 1884 - protein, 15 aa, Blattella germanica
KAHSMRNSASMDLSS

SEQ ID NO: 1885 - protein, 15 aa, Blattella germanica
EAGFAKLAASDSKSL

SEQ ID NO: 1886 - protein, 15 aa, Blattella germanica
DVLQWQTIPYTTIHN

SEQ ID NO: 1887 - protein, 15 aa, Blattella germanica
KLYKMAVAFMLAYPY

SEQ ID NO: 1888 - protein, 15 aa, Blattella germanica
AGTWSALNSIQQFIS

SEQ ID NO: 1889 - protein, 15 aa, Blattella germanica
VIYVQIRFSVRRFHP

SEQ ID NO: 1890 - protein, 15 aa, Blattella germanica
RGNNAIKWLVNFGVG

SEQ ID NO: 1891 - protein, 15 aa, Blattella germanica
KFEGNKFTIDYNDKG

SEQ ID NO: 1892 - protein, 15 aa, Blattella germanica
PLKKETIPYYTKKFD

SEQ ID NO: 1893 - protein, 15 aa, Blattella germanica
QKGYMVSSMTDLWEA

SEQ ID NO: 1894 - protein, 15 aa, Blattella germanica
SPYFVTNTEKMITEF

SEQ ID NO: 1895 - protein, 15 aa, Blattella germanica
RILLRLHRCFQVLGR

SEQ ID NO: 1896 - protein, 15 aa, Blattella germanica
RSEERLATATAKLAE

SEQ ID NO: 1897 - protein, 15 aa, Blattella germanica
WCNEEDHLRIISMQM

SEQ ID NO: 1898 - protein, 15 aa, Blattella germanica
RCNNVGIRIYVDVVL

SEQ ID NO: 1899 - protein, 15 aa, Blattella germanica
LDYLNHMAKEDLVAN

SEQ ID NO: 1900 - protein, 15 aa, Blattella germanica
AKRFAKWALPLYNKP

SEQ ID NO: 1901 - protein, 15 aa, Blattella germanica
GEKDFEDYRFQEGDW

SEQ ID NO: 1902 - protein, 15 aa, Blattella germanica
FYTEFDMENNRVGFA

SEQ ID NO: 1903 - protein, 15 aa, Blattella germanica
CPTNLGTTVRASVRI

SEQ ID NO: 1904 - protein, 15 aa, Blattella germanica
FRPWWERYQLVSYNL

SEQ ID NO: 1905 - protein, 15 aa, Blattella germanica
IVINNAGILNDEKWE

SEQ ID NO: 1906 - protein, 15 aa, Blattella germanica
DENSKQKKWDPLKKE

SEQ ID NO: 1907 - protein, 15 aa, Blattella germanica
LIPVDQIIAIATDYL

SEQ ID NO: 1908 - protein, 15 aa, Blattella germanica
GHSHFVSDVVLSSDG

SEQ ID NO: 1909 - protein, 15 aa, Blattella germanica
IHENLIVTSPFRPWW

SEQ ID NO: 1910 - protein, 15 aa, Blattella germanica
KAIFIKCDVTNIPEF

SEQ ID NO: 1911 - protein, 15 aa, Blattella germanica
MAPSYKLTYCPVKAL

SEQ ID NO: 1912 - protein, 15 aa, Blattella germanica
LNAIEFINNIHDLLG

SEQ ID NO: 1913 - protein, 15 aa, Blattella germanica
FLLSYGEKDFEDYRF

SEQ ID NO: 1914 - protein, 15 aa, Blattella germanica
QDVHKKLREWLSKNV

SEQ ID NO: 1915 - protein, 15 aa, Blattella germanica
HGRTFSSLFQVANQY

SEQ ID NO: 1916 - protein, 15 aa, Blattella germanica
WVPSKKCHLTNIACL

SEQ ID NO: 1917 - protein, 15 aa, Blattella germanica
KNMTYVNTSLVLAFS

SEQ ID NO: 1918 - protein, 15 aa, Blattella germanica
KDDWENLEIDMIVDT

SEQ ID NO: 1919 - protein, 15 aa, Blattella germanica
QKKWDPLKKETIPYY

SEQ ID NO: 1920 - protein, 15 aa, Blattella germanica
MNITGSINLMFSQMY

SEQ ID NO: 1921 - protein, 15 aa, Blattella germanica
PVDQIIAIATDYLAN

SEQ ID NO: 1922 - protein, 15 aa, Blattella germanica
QIIAIATDYLANDAE

SEQ ID NO: 1923 - protein, 15 aa, Blattella germanica
MGVQKFWAFDNTTFS

SEQ ID NO: 1924 - protein, 15 aa, Blattella germanica
IQGKFGLDATAVGDE

SEQ ID NO: 1925 - protein, 15 aa, Blattella germanica
QQFISSEMVEPKEAS

SEQ ID NO: 1926 - protein, 15 aa, Blattella germanica
IDDIIAILPVDDLYA

SEQ ID NO: 1927 - protein, 15 aa, Blattella germanica
QPNLKALREKVLGLP

SEQ ID NO: 1928 - protein, 15 aa, Blattella germanica
KVFLKNYLVGNAQFK

SEQ ID NO: 1929 - protein, 15 aa, Blattella germanica
VVRLQSWQSEMLRMN

SEQ ID NO: 1930 - protein, 15 aa, Blattella germanica
HTKLSSSSSITLTLP

SEQ ID NO: 1931 - protein, 15 aa, Blattella germanica
KIGEYKNMIAEGIID

SEQ ID NO: 1932 - protein, 15 aa, Blattella germanica
KALQNAESEVAALNR

SEQ ID NO: 1933 - protein, 15 aa, Blattella germanica
IRFSVRRFHPKLGDK

SEQ ID NO: 1934 - protein, 15 aa, Blattella germanica
KAIEEDLKHFNLKYE

SEQ ID NO: 1935 - protein, 15 aa, Blattella germanica
THQFNVAGSVTVDKT

SEQ ID NO: 1936 - protein, 15 aa, Blattella germanica
IRHAILAAGDLYSRR

SEQ ID NO: 1937 - protein, 15 aa, Blattella germanica
RDMVRRCNNVGIRIY

SEQ ID NO: 1938 - protein, 15 aa, Blattella germanica
KLGDKEMIQHYTLDQ

SEQ ID NO: 1939 - protein, 15 aa, Blattella germanica
NASAVIQEFLKTYKK

SEQ ID NO: 1940 - protein, 15 aa, Blattella germanica
VVFDTGSSNLWVPSK

SEQ ID NO: 1941 - protein, 15 aa, Blattella germanica
EVVKANGGYLAAGKL

SEQ ID NO: 1942 - protein, 15 aa, Blattella germanica
AQIQVVIHLDEQYIY

SEQ ID NO: 1943 - protein, 15 aa, Blattella germanica
ALNSIQQFISSEMVE

SEQ ID NO: 1944 - protein, 15 aa, Blattella germanica
KAAVHLLVAVKASKE

SEQ ID NO: 1945 - protein, 15 aa, Blattella germanica
LVYPTSLGFPLKLVL

SEQ ID NO: 1946 - protein, 15 aa, Blattella germanica
DKKVYRVFESTVTGR

SEQ ID NO: 1947 - protein, 15 aa, Blattella germanica
QTHQSVAISRYLGKQ

SEQ ID NO: 1948 - protein, 15 aa, Blattella germanica
TGILYKARLSLDRNE

SEQ ID NO: 1949 - protein, 15 aa, Blattella germanica
SINLMFSQMYHAQLA

SEQ ID NO: 1950 - protein, 15 aa, Blattella germanica
STSCNVVVASQECVG

SEQ ID NO: 1951 - protein, 15 aa, Blattella germanica
KQLKVSQIMEAARKL

SEQ ID NO: 1952 - protein, 15 aa, Blattella germanica
PNLKPSMPFGKTPVL

SEQ ID NO: 1953 - protein, 15 aa, Blattella germanica
NTTFSNASAVIQEFL

SEQ ID NO: 1954 - protein, 15 aa, Blattella germanica
RIKAFLALVECPCNK

SEQ ID NO: 1955 - protein, 15 aa, Blattella germanica
KKLQFTYSESLDLDD

SEQ ID NO: 1956 - protein, 15 aa, Blattella germanica
VEALFLLMKADPSIH

SEQ ID NO: 1957 - protein, 15 aa, Blattella germanica
SVNATVVRLQSWQSE

SEQ ID NO: 1958 - protein, 15 aa, Blattella germanica
LNTYYSYYYFNYPTF

SEQ ID NO: 1959 - protein, 15 aa, Blattella germanica
VNQHKKAIEEDLKHF

SEQ ID NO: 1960 - protein, 15 aa, Blattella germanica
VFIGKFYTEFDMENN

SEQ ID NO: 1961 - protein, 15 aa, Blattella germanica
LTVFDSTSCNVVVAS

SEQ ID NO: 1962 - protein, 15 aa, Blattella germanica
LVFLRNAKIELKPNQ

SEQ ID NO: 1963 - protein, 15 aa, Blattella germanica
DCGVAGFRVDAAKHM

SEQ ID NO: 1964 - protein, 15 aa, Blattella germanica
SEVTALNRQIGGTPI

SEQ ID NO: 1965 - protein, 15 aa, Blattella germanica
NVIYSQNSFLPRATT

SEQ ID NO: 1966 - protein, 15 aa, Blattella germanica
EIDGKQTHQSVAISR

SEQ ID NO: 1967 - protein, 15 aa, Blattella germanica
YHYDADENSKQKKWD

SEQ ID NO: 1968 - protein, 15 aa, Blattella germanica
KVIDLLLSLYLDQNE

SEQ ID NO: 1969 - protein, 15 aa, Blattella germanica
DRRGEMFYYTRQQLY

SEQ ID NO: 1970 - protein, 15 aa, Blattella germanica
LWEINMIKAIISQLQ

SEQ ID NO: 1971 - protein, 15 aa, Blattella germanica
EMIQHYTLDQVNQHK

SEQ ID NO: 1972 - protein, 15 aa, Blattella germanica
ARYFLERLSNDLPDV

SEQ ID NO: 1973 - protein, 15 aa, Blattella germanica
DVLDIGGLKVQKQTF

SEQ ID NO: 1974 - protein, 15 aa, Blattella germanica
KELVEKYGKGKAIFI

SEQ ID NO: 1975 - protein, 15 aa, Blattella germanica
ERYQLVSYNLNSRSG

SEQ ID NO: 1976 - protein, 15 aa, Blattella germanica
FSQMYHAQLAFSTAF

SEQ ID NO: 1977 - protein, 15 aa, Blattella germanica
VYEVAIPDRLTLRVE

SEQ ID NO: 1978 - protein, 15 aa, Blattella germanica
DPSIHVLKMVAELTH

SEQ ID NO: 1979 - protein, 15 aa, Blattella germanica
GKDYILRVSQLGHTV

SEQ ID NO: 1980 - protein, 15 aa, Blattella germanica
IAGPVSEVTALNRQI

SEQ ID NO: 1981 - protein, 15 aa, Blattella germanica
SHVHFRFVPSAAVEF

SEQ ID NO: 1982 - protein, 15 aa, Blattella germanica
FRKFSNNFEFSYLLG

SEQ ID NO: 1983 - protein, 15 aa, Blattella germanica
GEPIRFLLSYGEKDF

SEQ ID NO: 1984 - protein, 15 aa, Blattella germanica
VQKLQKEVDRLEDEL

SEQ ID NO: 1985 - protein, 15 aa, Blattella germanica
KEFANVVRVVRHTSK

SEQ ID NO: 1986 - protein, 15 aa, Blattella germanica
GQEYTFYVIVTPYAK

SEQ ID NO: 1987 - protein, 15 aa, Blattella germanica
LGHTVCLSGFMGIDL

SEQ ID NO: 1988 - protein, 15 aa, Blattella germanica
CATDTLANEDCFRHE

SEQ ID NO: 1989 - protein, 15 aa, Blattella germanica
AAVAYLQSDEFETIV

SEQ ID NO: 1990 - protein, 15 aa, Blattella germanica
KTPVLSVNATVVRLQ

SEQ ID NO: 1991 - protein, 15 aa, Blattella germanica
QTLFLLLLLLAAVSA

SEQ ID NO: 1992 - protein, 15 aa, Blattella germanica
LKNYQLDSELRIKAF

SEQ ID NO: 1993 - protein, 15 aa, Blattella germanica
LRLSEHLDYVKNLTV

SEQ ID NO: 1994 - protein, 15 aa, Blattella germanica
HHQRLFMVQSLERVV

SEQ ID NO: 1995 - protein, 15 aa, Blattella germanica
LNDYILPAPYEIYPW

SEQ ID NO: 1996 - protein, 15 aa, Blattella germanica
NAIEFLNNIHDLLGI

SEQ ID NO: 1997 - protein, 15 aa, Blattella germanica
AVLALCATDTLANED

SEQ ID NO: 1998 - protein, 1583 aa, Blattella germanica
  MOD_RES (1575)..(1578): Any naturally occurring amino acid
ALLCCLLVSAASAITPGWLPINSQLDYHVHGRTFSSLFQVANQYTGILYKARLSLDRNEDQLITGKVTEAQFAPVNTQFSSGWDESVPDEKLHWDVVPMSQQPFQIELNSRGEVRKLRVNKFVELWEINMIKAIISQLQVVVDEDKKVYRVFESTVTGRCEALYEVDHLYPTTYLNPWQWTQQHDTKLRIMKNHQFTNCRHNSAYKLHFNAFEYFHLKQHKPETFLSNSAVSRVIADGDNLKNFTFYSGETIHKIVLNPEIYNKQKGMLVSHINVTVERKGRELTVIDYELRNVGDLSYSTSLVKAHSMRNSASMDLSSSSMSSSSSSSSSSSSSSSSSSSSSSSEEHHSHNQKLSKKRQVPLPRPLFEANFDASSGLTTEQPVTFRPRRQLFQGQDMSEEETEQNPEIIPANLLPTYNLIHNTKQVDVDPVGVAVRLSKDIAADLQGEPRVGEDRHILPRFTILVRLLKQLKVSQIMEAARKLYKLENDHPNYMNWDTWRVYRDAVSQAGTWSALNSIQQFISSEMVEPKEASHLITVLPAAVSDKNKAYLHFLFEMTKDPVFKNMTYVNTSLVLAFSEVIHQVEMHQVRDLKIKSVYIPYLVQEFDDAVKENNSIKIQLYTHALGVTGNTHILHYLRPYIIQLKTITHHQRLFMVQSLERVVEHNPRKVIDLLLSLYLDQNEHADIRVEALFLLMKADPSIHVLKMVAELTHTESNNQVLSASQSAIKSAANVEGDIYSEMRRKAKAVEHLLSTRNMDVSYSKSYLYGYKSKKINYDSLYNLNNIGSEDSIYPKSMLLNIFTNNLGRINTHVQKGYMVSSMTDLWEAFHTIYKKDNGSPTDPKTLVKFVEGNLKYFNMGVQKFWAFDNTTFSNASAVIQEFLKTYKKPTNFNHTKLSSSSSITLTLPCAMGLPAYFKMNSPSLWKYNGEFSIQTDAKTDVPMSLENFMNITGSINLMFSQMYHAQLAFSTAFDNKEYISGLDRKVEVHVPVKFQINLDFKNHNGFIRIIPLFTDRDYDVLQWQTIPYTTIHNVPDFETVYMDQLFKLIHVRKTAHFEKKMGENTGIVFKVKYDTDQEFLDTKWFLDEFKVLQLFTGLNYDVPTKDIFYNNLTVYYDHEDTKNHAVSFTVTKEQSKFYETLNPVVQQNLKLSSGKKQKHRNVKSHRIRREYTEDENPAIPKDKQPNSHPRRQEYLSKSMALTGDATAVVLDMTLKFEGPAESYFTTTVSHATSLVNGSSNYLLFYDQHYYEEKKRNQFCLSWSVYKPQVPIMNIYSAFEFDPNSKVHAIMNIGKECENGGSAVANIDMLRLSEHLDYVKNLTVSKLCDHEMRTKRDHVLPACRNSTERASDLNRVHVDINYNLKQHETFKRRVYKVYDFVRTHLYPHVSEDVIVDNPAQFISANFTLKDNTRAFNVSIKTPVLSVNATVVRLQSWQSEMLRMNPRTSFAKRFAKWALPLYNKPTCVVDSSYINTFDNFTYSAHHIVQNDAFYTILDIPQKFNMEYFKVAFKPTSPVPNMQREVLVFLRNAKIELKPNQGMPEVYVEGKRVDYNHHHSTDLNVSQDRIGYVYAFXXXXSSRKP

SEQ ID NO: 1999 - protein, 1250 aa, Blattella germanica
  MOD_RES (1223)..(1223): Any naturally occurring amino acid
YHCLSSGINAEYAGSSSTPCSNMTWNALLCCLLVSAASAITPGWLPINSQLDYHVHGRTFSSLFQVANQYTGILYKARLSLDRNEDQLITGKVTEAQFSPVNTQFSSGWDESVPDEKLHWDVVPMSQQPFQIELNSRGEVRKLRVNKFVELWEINMIKAIISQLQVVVDEDKKVYRVFESTVTGRCEALYEVDHLYPTTYLNPWQWTQQHDTKLRIMKNHQFTNCRHNSAYKLHFNAFEYFHLKQHKPETFLSNSAVSRVIADGDNLKNFTFYSGETIHKIVLNPEIYNKQKGMLVSHINVTVERKGRELTVIDYELRNVGDLSYSTSLVKAHSMRNSASMDLSSSSMSSSSSSSSSSSSSSSSSSSSSEEHHSHNQKLSKKRQVPLPRPLFEANFDASSGLTTEQPVTFRPRRQLFQGQDMSEEETEQNPEIIPANLLPTYNLIHNTKQVDVDPVGVAVRLSKDIAADLQGEPRVGEDRHILPRFTILVRLLKQLKVSQIMEAARKLYKLENDHPNYMNWDTWRVYRDAVSQAGTWSALNSIQQFISSEMVEPKEASHLITVLPAAVSDKNKAYLHFLFEMTKDPVFKNMTYVNTSLVLAFSEVIHQVEMHQVRDLKIKSVYIPYLVQEFDDAVKENNSIKIQLYTHALGVTGNTHILHYLRPYIIQLKTITHHQRLFMVQSLERVVEHNPRKVIDLLLSLYLDQNEHADIRVEALFLLMKADPSIHVLKMVAELTHTESNNQVLSASQSAIKSAANVEGDIYSEMRRKAKAVEHLLSTRNMDVSYSKSYLYGYKSKKINYDSLYNLNYIGSEDSIYPKSMLLNIFTNNLGRINTHVQKGYMVSSMTDLWEAFHTIYKKDNGSPTDPKTLVKFVEGNLKYFNMGVQKFWAFDNTTFSNASAVIQEFLKTYKKPTNFNHTKLSSSSSITLTLPCAMGLPAYFKMNSPSLWKYNGEFSIQTDAKTDVPMSLENFMNITGSINLMFSQMYHAQLAFSTAFDNKEYISGLDRKVEVHVPVKFQINLDFKNHNGFIRIIPLFTDRDYDVLQWQTIPYTTIHNVPDFETVYMDQLFKLIHVRKTAHFEKKMGENTGIVFKVKYDTDQEFLDTKWFLDEFKVLQLFTGLNYDVPTKDIFYNNLTVYYDHEDTKNHAVSFTVTKEQSKFYETLNPVVQQNLKLSSGKKQKHRNVKSHRIRREYTEDENPAIPKDKQPNSHPRRQEYLSKXMALTGDATAVVLDMTLKFEGPAESYFT

SEQ ID NO: 2000 - protein, 804 aa, Blattella germanica
TAHFEKKMGENTGIVFKVKYDTDQEFLDTKWFLDEFKVLQLFTGLNYDVPTKDIFYNNLTVYYDHEDTKNHAVSFTVTKEQSKFYETLNPVVQQNLKLSSGKKQKHRNVKSHRIRREYTEDENPAIPKDKQPNSHPRRQEYLSKSMALTGDATAVVLDMTLKFEGPAESYFTTTVSHATSLVNGSSNYLLFYDQHYYEEKKRNQFCLSWSVYKPQVPIMNIYSAFEFDPNSKVHAIMNIGKECENGGSAVANIDMLRLSEHLDYVKNLTVSKLCDHEMRTKRDHVLPACRNSTERASDLNRVHVDINYNLKQHETFKRRVYKVYDFVRTHLYPHVSEDVIVDNPAQFISANFTLKDNTRAFNVSIETPVLSVNATSVRLQSWQSEMLRMNPRTSFAKRFAKWALPLYYKPTCVVDSSYINTFDNFTYSAHHIVQNDAFYTILDIPQKFNMEYFKVAFKPTSPVPNMQREVLVFLRNAKIELKPNQGMPEVYVEGKRVDYNHHHSTDLNVSQDRIGYVYALPTKAAHIVFPSYEIEMFYDGSRIMIQASNMYRNFTKGLCGNMDGEFVNDVLTPWGCYAKDMALFVASYADNSNSEVRKIKATQNEQTCVPQFHQPLVSHQMRLSQVIKLADTSSSSESSSSSESHENNSSPSSESQVNKSKRQPNSRPRSSSSSSSSSSSESNESVLAKKIINNQIGPKPTLIPSQSPMTSDDKCMTQQPRHTYYENQFCVSEKPLDTCMPLICHATESYTIDVNFYCVPLGPAANHYMKLVKKGILPDLSRNRNGKRVVLPVEIPIQCEPVLN

SEQ ID NO: 2001 - protein, 709 aa, Blattella germanica
ESNNQVLSASQSAIKSAANVEGDIYSEMRRKAKAVEHLLSTRNMDVSYSKSYLYGYKSKKINYDSLYNLNYIGSEDSIYPKSMLLNIFTNNLGRINTHVQKGYMVSSMTDLWEAFHTIYKKDNGSPTDPKTLVKFVEGNLKYFNMGVQKFWAFDNTTFSNASAVIQEFLKTYKKPTNFNHTKLSSSSSITLTLPCAMGLPAYFKMNSPSLWKYNGEFSIQTDAKTDVPMSLENFMNITGSINLMFSQMYHAQLAFSTAFDNKEYISGLDRKVEVHVPVKFQINLDFKNHNGFIRIIPLFTDRDYDVLQWQTIPYTTIHNVPDFETVYMDQLFKLIHVRKTAHFEKKMGENTGIVFKVKYDTDQEFLDTKWFLDEFKVLQLFTGLNYDVPTKDIFYNNLTVYYDHEDTKNHAVSFTVTKEQSKFYETLNPVVQQNLKLSSGKKQKHRNVKSHRIRREYTEDENPAIPKDKQPNSHPRRQEYLSKSMALTGDATAVVLDMTLKFEGPAESYFTTTVSHATSLVNGSSNYLLFYDQHYYEEKKRNQFCLSWSVYKPQVPIMNIYSAFEFDPNSKVHAIMNIGKECENGGSAVANIDMLRLSEHLDYVKNLTVSKLCDHEMRTKRDHVLPACRNSTERASDLNRVHVDINYNLKQHETFKRRVYKVYDFVRTHLYPHVSEDVIVDNPAQFISANFTLKDNTRAFNVSIKTTCT

SEQ ID NO: 2002 - protein, 384 aa, Blattella germanica
YKLENDHPNYMNWDTWRVYRDAVSQAGTWSALNSIQQFISSEMVEPKEASHLITVLPAAVSDKNKAYLHFLFEMTKDPVFKNMTYVNTSLVLAFSEVIHQVEMHQVRDLKIKSVYIPYLVQEFDDAVKENNSIKIQLYTHALGVTGNTHILHYLRPYIIQLKTITHHQRLFMVQSLERVVEHNPRKVIDLLLSLYLDQNEHADIRVEALFLLMKADPSIHVLKMVAELTHTESNNQVLSASQSAIKSAANVEGDIYSEMRRKAKAVEHLLSTRNMDVSYSKSYLYGYKSKKINYDSLYNLNYIGSEDSIYPKSMLLNIFTNNLGRINTHVQKGYMVSSMTDLWEAFHTIYKKDNGSPTDPKTLVKFVEGNLKYFNIGCPEILGI

SEQ ID NO: 2003 - protein, 364 aa, Blattella germanica
EQKINYDSLYNLNYIGSEDSIYPKSMLLNIFTNNLGRINTHVQKGYMVSSMTDLWEAFHTIYKKDNGSPTDPKTLVKFVEGNLKYFNMGVQKFWAFDNTTFSNASAVIQEFLKTYKKPTNFNHTKLSSSSSITLTLPCAMGLPAYFKMNSPSLWKYNGEFSIQTDAKTDVPMSLENFMNITGSINLMFSQMYHAQLAFSTAFDNKEYISGLDRKVEVHVPVKFQINLDFKNHNGFIRIIPLFTDRDYDVLQWQTIPYTTIHNVPDFETVYMDQLFKLIHVRKTAHFEKKMGENTGIVFKVKYDTDQEFLDTKWFLDEFKVLQLFTGLNYDVPTKDIFYNNLTVYYDHEDTKNHSRIFYCDKRTI

SEQ ID NO: 2004 - protein, 315 aa, Blattella germanica
MTWNALLCCLLVSAASAITPGWLPINSQLDYHVHGRTFSSLFQVANQYTGILYKARLSLDRNEDQLITGKVTEAQFSPVNTQFSSGWDESVPDEKLHWDVVPMSQQPFQIELNSRGEVRKLRVNKFVELWEINMIKAIISQLQVVVDEDKKVYRVFESTVTGRCEALYEVDHLYPTTYLNPWQWTQQHDTKLRIMKNHQFTNCRHNSAYKLHFNAFEYFHLKQHKPETFLSNSAVSRVIADGDNLKNFTFYSGETIHKIVLNPEIYNKQKGMLVSHINVTVERKGRELTVIDYELRNVGDLSYSTSLVKDTFDEK

SEQ ID NO: 2005 - protein, 281 aa, Blattella germanica
NLQKPTNFNHTKLSSSSSITLTLPCAMGLPAYFKMNSPSLWKYNGEFSIQTDAKTDVPMSLENFMNITGSINLMFSQMYHAQLAFSTAFDNKEYISGLDRKVEVHVPVKFQINLDFKNHNGFIRIIPLFTDRDYDVLQWQTIPYTTIHNVPDFETVYMDQLFKLIHVRKTAHFEKKMGENTGIVFKVKYDTDQEFLDTKWFLDEFKVLQLFTGLNYDVPTKDIFYNNLTVYYDHEDTKNHAVSFTVTKEQSKFYETLNPVVQQNLKLSSGKKQKHRNVKSH

SEQ ID NO: 2006 - protein, 259 aa, Blattella germanica
LYIMIMKTPKTIAVSFTVTKEQSKFYETLNPVVQQNLKLSSGKKQKHRNVKSHRIRREYTEDENPAIPKDKQPNSHPRRQEYLSKSMALTGDATAVVLDMTLKFEGPAESYFTTTVSHATSLVNGSSNYLLFYDQHYYEEKKRNQFCLSWSVYKPQVPIMNIYSAFEFDPNSKVHAIMNIGKECENGGSAVANIDMLRLSEHLDYVKNLTVSKLCDHEMRTKRDHVLPACRNSTERASDLNRVHVDINYNLKQHETFKR

SEQ ID NO: 2007 - protein, 255 aa, Blattella germanica
  MOD_RES (168)..(168): Any naturally occurring amino acid
QHETFKRRVYKVYDFVRTHLYPHVSEDVIVDNPAQFISANFTLKDNTRAFNVSIKTPVLSVNATVVRLQSWQSEMLRMNPRTSFAKRFAKWALPLYNKPTCVVDSSYINTFDNFTYSAHHIVQNDAFYTILDIPQKFNMEYFKVAFKPTSPVPNMQREVLVFLRNAKXELKPNQGMPEVYVEGKRVDYNHHHSTDLNVSQDRIGYVYALPTKAAHIVFPSYEIEMFYDGSRIMIQASNMYRNFTKGLCGKISVHI

SEQ ID NO: 2008 - protein, 224 aa, Blattella germanica
TSLGSINLMFSQMYHAQLAFSTAFDNKEYISGLDRKVEVHVPVKFQINLDFKNHNGFIRIIPLFTDRDYDVCNGRLFHTQPSITYQTLKQSTWINYFKLIHVRKTAHFEKKMGENTGIVFKVKYDTDQEFLDTKWFLDEFKVLQLFTGLNYDVPTKDIFYNNLTVYYDHEDTKNHAVSFTVTKEQSKFYETLNPVVQQNLKLSSGKKQKHRNVKSHRIRREYTE

SEQ ID NO: 2009 - protein, 200 aa, Blattella germanica
SSSTPCSNMTWNALLCCLLVSAASAITPGWLPINSQLDYHVHGRTFSSLFQVANQYTGILYKARLSLDRNEDQLITGKVTEAQFSPVNTQFSSGWDESVPDEKLHWDVVPMSQQPFQIELNSRGEVRKLRVNKFVELWEINMIKAIISQLQVVVDEDKKVYRVFESTVTGRCEALYEVDHLYPTTYLNPWQWTQQHDTKL

SEQ ID NO: 2010 - protein, 149 aa, Blattella germanica
YHVHGRTFSSLFQVANQYTGILYKARLSLDRNEDQLITGKVTEAQFSPVNTQFSSGWDESVPDEKLHWDVVPMSQQPFQIELNSRGEVRKLRVNKFVELWEINMIKAIISQLQVVVDEDKKVYRVFESTVTGRCEALYEVDHLYPNNIY

SEQ ID NO: 2011 - protein, 124 aa, Blattella germanica
WQWTQQHDTKLRIMKNHQFTNCRHNSAYKLHFNAFEYFHLKQHKPETFLSNSAVSRVIADGDNLKNFTFYSGETIHKIVLNPEIYNKQKGMLVSHINVTVERKGRELTVIDYELRNVGRSLLLN

SEQ ID NO: 2012 - protein, 118 aa, Blattella germanica
RHNSAYKLHFNAFEYFHLKQHKPETFLSNSAVSRVIADGDNLKNFTFYSGETIHKIVLNPEIYNKQKGMLVSHINVTVERKGRELTVIDYELRNVGDLSYSTSLVKAHSMRNSASIGS

SEQ ID NO: 2013 - protein, 113 aa, Blattella germanica
FNMEYFKVAFKPTSPVPNMQREVLVFLRNAKIELKPNQGMPEVYVEGKRVDYNHHHSTDLNVSQDRIGYVYALPTKAAHIVFPSYEIEMFYDGSRIMIQASNMYRNFTKGLLW

SEQ ID NO: 2014 - protein, 731 aa, Blattella germanica
  MOD_RES (4)..(4): Any naturally occurring amino acid
TALXLILATAALAVAYPSPGQDYKVLADKTYLTRQRDLLKLLVRIQQPNYYADQYEIGQSYDIEANINNYKYPYVVKNFVAAYKNGMLARGVPYSPYYTTQSYETKLLFDLFYYANDYDTFYKTACWARDHINEGQFLYALSSALFQREDLNDYILPAPYEIYPWLFVDSDVIQRAYETRMSDVHLTAPKTYIFPVNYTVHTPEQELNYFYHDVGLNTYYSYYYFNYPTFFNSTEYGVQFDRRGEMFYYTRQQLYARYFLERLSNDLPDVEPLHYDRPFQTEYNPQLRYPNGEDMPVRPYEYSRRSLYYSNGYSHYYGNYYGGNNEYYTGNYYTGDYHPSYYYGYATQYDYYYPEDLQSYERRVRDAIDYGYFFGFQGEKYPLYENYIKGIDYLGDVIEGNGDMVNQRFYGSIYHYYRQLAGKSVDPYNNYGLAPSALQNIYTTLRDPANWQILKRVNYLFQRYKGYLPRYTYDELSFPGIRIDNVDVGKLVTYFEHFDVDLDNVVNVKVAEDGKYIDYRARQTRLNHKPFTYNIEVHSEQATDAYVRVFLGPKYDYLHSEYDLNDRRHYFVEIDRFPYKVQAGKTTITRNSRDSSVVSPDYQSYRTLMRKVYDAYEGKDQFYYDKSEQYCGYPERLLLPKGKLGGQEYTFYVIVTPYAKQDDHDFEPYNYKSFSYCGVGANHRIPDDKPLGYPFDRPVYSHDFVTPNMYFKDVVIYHKKYEEINAATTHQ

SEQ ID NO: 2015 - protein, 382 aa, Blattella germanica
  MOD_RES (204)..(204): Any naturally occurring amino acid
YYGGNNNYYNGNYYTGDYKPTYYYGYANQYDYYYPEDLQTYERRVRDAIDYGYFFGFPGGKYPLYDDYIKGIDYLGDAIEGNGDTVNKRLYGSIYHYYRQLAGKNVDPYNDIGLAPSALQNIYTTLRDPANWQILKRVNYLFQRYKGYLPRYTYDELSFPGVRVDNVDVGKLVTYFDYFDIDLDNVVNVKVAEDGKYVDYRARXTRLNHKPFTYNVEVYSEQATDVYVRVFLGPKYDYLHREYDLNDRRHYFVEIDRFPYKVQSGKTTITRNSRDSSVVSPDYQSYRTLMRKVYDAYEGKDKFYYDRSENYCGYPERLLLPKGKLGGQEYTFYVIVTPYVKQDDHDFEPYNYKSFSYCGVGANHRIPDDKPLGYPFDRPVYR

SEQ ID NO: 2016 - protein, 83 aa, Blattella germanica
  MOD_RES (81)..(81): Any naturally occurring amino acid
YEYDVPRHGEQFYYFYQQIYARYMLERYSNDMPDIKPFTYNKAFKTPYNPQLRYPNGQEVPARPAYMVPQDFDLYMCLTSXNY

SEQ ID NO: 2017 - protein, 264 aa, Blattella germanica
FSNMDIKGKNALVTGAATGIGLEYVKQLLENGAQHVAVCDLDVRKGENAVKELVEKYGKGKAIFIKCDVTNIPEFEDAFKKAYNAFKSLDIVINNAGILNDEKWELQIAINVNGVVRGTLLGLEYMGKDKGGKGGVIVNIASILGLQNMAGCPVYVGTKHAVVGISRSFGMPFHFDRTGVRVLTMCPGVTDTPLISEAHHRQPGEWGEECGRELDSLPKQPPENVAKGMMHMIKKGANGSVWVCEGNKPVYEVAIPDRLTLRVE

SEQ ID NO: 2018 - protein, 1585 aa, Blattella germanica
CLSSGINAEYAGVLWVCATGMARQVTSKGQQTLFLLLLLLAAVSASQQCKPKCEGKSSAFQTHYEAGNTYVYSFEGGTTTSLPGQQGDGVKLHLKAKAEVSFGDACEAVLKLKDVQVTGPDAQKFTHLNDLESHPVSFSFENGVVGGHICANGHDSEASLNLKRAILAHFQVAPQETARSGKSVVLDVFGLCPTDYSYTERGGTTTITKSRNLNKCHLREHLRQDFASVTYHVESDLQNSPLMESTQEFKHQLQGGVLRVSESHEKYLYRPFANQDAGAKTVVDSKLTYVGHNKKTAPAVSGAEQQSIIFHPPNVHPGSGSAASVVDALHKAHQAMPEYVGENAAKEFANVVRVVRHTSKNDLLSVYNQVKSGAGFKDKSAGTKMFLDALFRAGTGDAVEVAVELLKSNKITGPHAEFYYLQLAYTRHVTKAALLAAVTLLEQPNPSKLAYLGVGALAGRYCSEHRCDGVAEVDEFLEKLSLLLNGGCKVSNYDEEVKIVATLKALQNAHHLNDAVTSKLQTCLLDDGVPTRIRSAVLDVFQSDACKAKDISLEVLKNYQLDSELRIKAFLALVECPCNKKANDLKELLDKEPSYQVGSFIVSYLRNLRASANPSKEKQKAVFGEIRTTKRFPIDFRKFSNNFEFSYLLGGANVGTTVESNVIYSQNSFLPRATTLNLTTEFFGHSVNLLEVELRQENLDLLAEGLFGPKGYFNTHTAAEVVQKGKEHWTDVENTAKQRFNHAIRGKRSVTKEQLELVKSKSVSPYHSETDRELLLELSTRLFGAEVGWLALHHNARDAAKNAFDTTFNLLDKVMKKAKDFDYKLRQHNTFLDTELVYPTSLGFPLKLVLAGSSAVHVELEGKVDVHDLVHNLKNSHVHFRFVPSAAVEFVGAFVVDAYAVEAGLKVAATLHTATGSDITVKATEDVGVDVTVGLPVQKQDIVTLKTEVLTTVQEKGKPEVNTEISLPGTPRRDYHGCFDQLSPLVGLTFCTTMSFPWDPVASKAAFYPLNGPSKFSLVVENEDVTSYHFRASLNKADPHKKSLELLLETPGSKTERKLGLILERTYDPYHGVKAQLNSPWKQVSAELAFTDNDKELSLLAKVTNDEQEYYVKLGASVTGDPNHATYHPLLEYKTPERKSSLVSKKGAKGAPEKLTHQFNVAGSVTVDKTANSKKYTFNDVVFTTPQGQYKVDGTVTSEGPTAFSTDLKVYYGENHVVLKSGFKRPSANNFNVHANVQPSQYPDFGVNLIWNHKRDKNNFGNSLAVVHGRDPNSEEARFTLNQEAHYQFDSIHKFEFASKNKVTYPLLGIIGKLDASVQPKTFHLDVEASYEKHKFEAELNANHGQQHTGDYDVKFHAKVLDNSLEFETKRVIVSEGKSKFTTELQVHPGGKYEAVADVTHVFERNNIDFQIDAEAKIHGQPDPYKLDSGLVYNPQLFDAHHKINVGAENYVDVSVNFKRGSGGNPSGNAKVFLKNYLVGNAQFKYTNGEGSATLNVDVPKLGRKLKGTGDLHVKGSQHVATVELYYNAEKKLAFHTDTDLKKDSLDSKNVLSILNYKTEVNVKGTLQGKLEDGQLKGEFGCNSA

SEQ ID NO: 2019 - protein, 718 aa, Blattella germanica
PKGKVSRTLKFHDHHYTGPFSVDNVLEFKLPSDKVKHIKMESHLQGELAEKKLQFTYSESLDLDDKTYKLSLESNNELEKGSNKLILVLPNKEPATYVNSWYFNYDDYRSKDVLKGGLTLTRNENAKFSIDVSGKKDYSDLDVHAKLDTPYEKLKHAELSLKNKYVPAPRLEVDTDFSLTVDDKKLAVVNKLTPGPFAGFPNIDFTATHPEGKTRVYVHLTSHKKNEVSGKAELEWPTNGGGKLTSSGKASYESFQNFRVEADIESAKLNLKKWHVLLANKPQAKGSSSKTLQIQATEAGQPVINGRLEFHVEDKENTYKAGVSGNVQVRSQSQPLKADVFFNKFNPTDNGELGAEVGITIHLGDKSFDALSKHTNKESRASVSVCYQAGQCSVAEAHSVVKVLDFNHLEHDFGAKFDFKACGVNEGFVLTGKNVRQPLSFDHAVELKLLNEKHTTYNFHSYLNEKALGVILTLPQRIIALEGKLGYDKEKGERKVDLGFWLDKKKQPDNKAAVHLLVAVKASKEGTTFHGDAKFSHPALNKEFSVTGKGIALQDDTLLDASVDLDIFAKKNQKITLVAKLERIPISHGYNVTGHLSAKGKLIDVSLDGGAALSADGASYISTLAYQDEKHKSKSAQIQVVIHLDEQYIYVKSPTAELIKIERHESNNGKNAKGEVFVLGLEPVEFDETEDFPVSSKAVYYKKILPTRSSPLISCTIC

SEQ ID NO: 2020 - protein, 468 aa, Blattella germanica
AGQTREHKEALTRENKKLGDDLHDARNQLADLNRRFHELEIELRRLENEREELTAAYKEAEAGRKAEEQRAQRLSAELGNFRHEAERRLAEKDEEIESIRKQTAIEIEQLNARVVEAETKLKTEVTRIKKKLQIQITELEMSLDVANKNNIELQKTIKKQSLTLTEIQAHYDEVQRQLQVTLDQYGIAQRKLQSVTAELEEIRGNYEGALRAKRTAEQQYEETISRVNELTTINVNLASAKSKVEQELSTLAGDYDEVTRELRAADERYQRVQVELKHTVEILHEEQERIVKIEAIKKSLEIEVKNLSVRLEEVEANAIVGGKRIISKLEARVRDLELELDEEKRRHAETIKILRKKERQVKEVMIQSEEDQKNVSLLQENLDKLVQRVNIYKRQLQEQEGMSQQSVTRVRRFQRELEAAEDRADTAESNLSLIRAKHRTFVTTSTVPGSQVYLVQETHRTTTTSEGI

SEQ ID NO: 2021 - protein, 343 aa, Blattella germanica
VHQVRLREYIDGPTPEPLSNYLDAQYYGPISLGTPPQKFKVVFDTGSSNLWVPSKKCHLTNIACLLHNKYDSTKSSTYEQNGTSFAIQYGSGSLSGFLSTDVLDIGGLKVQKQTFAEAMSEPGLAFVAAKFDGILGMAYSTISVDGVTPVFYNMVKQGLVSQPIFSFYLSRDPGAAEGGELILGGSDPNHYKGDFTYLSVDRKMYWQFKMDKIQIGNGSFCADGCEAIADTGTSLIAGPVSEVTALNRQIGGTPIVGGEYMVDCNLIPKLPEIDFILGGKKFTLEGKDYILRVSQLGHTVCLSGFMGIDLPKGPLWILGDVFIGKFYTEFDMENNRVGFAEAV

SEQ ID NO: 2022 - protein, 207 aa, Blattella germanica
HEGTPGHGSLLLEDTAGEKVRIIIDRFMDFREQEKKKLQSNPNLTVGDVTTVNLTQLKGGVQSNVVPPELVVVFDVRLAVTVDHAEFEAMVKKWCAEAGPGTYVEYEQKEPKVQVTKLDNSNPWWLAFKSACDDMNLELKPAIFPGGTDSRYVRGVGLPALGFSPMNKTPVLLHDHDEFLNEDIFLKGIDIFCQIIPAVANVAPPKK

SEQ ID NO: 2023 - protein, 203 aa, Blattella germanica
ALSPTTLGEAISSSTLRVFARTSVTGDLGIPEQQRYIEKVEELEAYQQQQQYKYVQELPESTSPPEFKTPIKDQPNIREGGFAHFEARLEPIGDSTLQVEWLKDGRPVEASSRITTFFNFGYVALTIKHVTTHDIGVYTCRAFNRLGQATTSAQLTVVSKKDIILESQHPGGLEKIQYLEDSSRYDRSTREETTVTQKPRFMG

SEQ ID NO: 2024 - protein, 197 aa, Blattella germanica
LFSTNILCDEIKNDEGVLVFTKENFKKGVSDNEFVLVEFYAPWCGHCKSLAPEYIKAAKKLADQESTIKLAKVDATEETELAEEHGVRGYPTLKFFRSGSPIDYSGGRTSDEIVSWLLKKTGPVAKDIASVDDAKSFIDASNVAIIGFFKDSSSEAAKNFLAAANAIDDYPFGITADDAVFGEYSVDGEKVILLQEV

SEQ ID NO: 2025 - protein, 193 aa, Blattella germanica
TREGERPMTKDNHLLGKFDLTGIPPAPRGVPQIEVTFEIDANGILQVSAEDKGTGNREKIVITNDQNRLTPDDIERMIKDAEKFADDDKKLKERVEARNELESYAYSLKNQLADKEKLGAKVSDSDKTKMEEAIDEKIKWLEENQDVDTEEYKTQKKELEDIVQPIIAKLYQGAGGAPPPSNSDDDDELKDEL

SEQ ID NO: 2026 - protein, 187 aa, Blattella germanica
QITVTTDDIGQDVSGLELGALLTAMAMVTAKLATVETSCNAQAQEDNHQRPWLNSPSMATKDRTSMTSVSSTDSTLVYKIQPVNNAHGGGDRRCGVAGCSKDLNPGCPNELRVNNGCKSSCYAFNTDQYCCRGQYGTVETCDTSRWPVNSASYFKSNCPDAYSYAYDDRTSTFTCDDRAYRTHHLLD

SEQ ID NO: 2027 - protein, 143 aa, Blattella germanica
SSLEVFFQQQRILLRLHRCFQVLGRWGGDVAFVKHLTALENTDGHNTAAWASGLKSEDYELLCPDGGRAPVTEYLRCHLAQVPPHMVVTSNDKTENQLNEIRHAILAAGDLYSRRPDLFKLFGDFDGTKDLLFKNSATGLLSV

SEQ ID NO: 2028 - protein, 140 aa, Blattella germanica
  MOD_RES (15)..(15): Any naturally occurring amino acid
RHQATQSTQQKKWYXKHCLQMASNTMPYQIASGFSTSQLAMIQNAIDEYHAKTCVTLRPYNSATDRDYVYIKGDESGCWSYVGRIGGRQELNLGTGCFSLGTVEHELLHAWGFYHQQSATERDDYVTIHWENIQSGTENN

SEQ ID NO: 2029 - protein, 133 aa, Blattella germanica
YGKIIKRLEAKGFKLVAMKFVWADEELLKKHYADLSSRPFFPGLVKYMSSGPVVPMVWEGLNVVKTGRLMLGATDPKDSNPGTIRGDLCIQVGRNIIHGSDSVESANKEINLWFDSKELIAWKPAVEAWVYED

SEQ ID NO: 2030 - protein, 130 aa, Blattella germanica
  MOD_RES (25)..(25): Any naturally occurring amino acid
STRMELQHLQSIEVFPEDEGQYVCXAVNSIGTAKTTCKLKVKPMQDAGRKAKSGDKAPVIVDHLKSDFVKDGEPVILSCRIIGAQKFDVVWLHNNKEIKPSKDFQYTNEANIYKLNIAEIFPEDSGTYTC

SEQ ID NO: 2031 - protein, 15 aa, Blattella germanica
DCGVAGFRVDAAKHM

SEQ ID NO: 2032 - protein, 15 aa, Blattella germanica
LDYERFRGSWIIAAG

SEQ ID NO: 2033 - protein, 15 aa, Blattella germanica
KNRTTIRGRTKFEGN

SEQ ID NO: 2034 - protein, 15 aa, Blattella germanica
IRGRTKFEGNKFTID

SEQ ID NO: 2035 - protein, 15 aa, Blattella germanica
KFEGNKFTIDYNDKG

SEQ ID NO: 2036 - protein, 15 aa, Blattella germanica
ATDYENYAIVEGCPA

SEQ ID NO: 2037 - protein, 15 aa, Blattella germanica
NYAIVEGCPAAANGH

SEQ ID NO: 2038 - protein, 15 aa, Blattella germanica
VIYVQIRFSVRRFHP

SEQ ID NO: 2039 - protein, 15 aa, Blattella germanica
IRFSVRRFHPKLGDK

SEQ ID NO: 2040 - protein, 15 aa, Blattella germanica
KLGDKEMIQHYTLDQ

SEQ ID NO: 2041 - protein, 15 aa, Blattella germanica
KAIEEDLKHFNLKYE

SEQ ID NO: 2042 - protein, 15 aa, Blattella germanica
KTPVLEIDGKQTHQS

SEQ ID NO: 2043 - protein, 15 aa, Blattella germanica
DENSKQKKWDPLKKE

SEQ ID NO: 2044 - protein, 15 aa, Blattella germanica
QKKWDPLKKETIPYY

SEQ ID NO: 2045 - protein, 15 aa, Blattella germanica
PLKKETIPYYTKKFD

SEQ ID NO: 2046 - protein, 15 aa, Blattella germanica
TIPYYTKKFDEVVKA

SEQ ID NO: 2047 - protein, 15 aa, Blattella germanica
TKKFDEVVKANGGYL

SEQ ID NO: 2048 - protein, 15 aa, Blattella germanica
YFVAILDYLNHMAKE

SEQ ID NO: 2049 - protein, 15 aa, Blattella germanica
QPNLKALREKVLGLP

SEQ ID NO: 2050 - protein, 15 aa, Blattella germanica
ALREKVLGLPAIKAW

SEQ ID NO: 2051 - protein, 15 aa, Blattella germanica
VLGLPAIKAWVAKRP

SEQ ID NO: 2052 - protein, 15 aa, Blattella germanica
VLEKLEAGFAKLAAS

SEQ ID NO: 2053 - protein, 15 aa, Blattella germanica
FGSTLLDVIQSGLEN

SEQ ID NO: 2054 - protein, 15 aa, Blattella germanica
NDIEKRVPFSHDDRL

SEQ ID NO: 2055 - protein, 15 aa, Blattella germanica
ALNSIQQFISSEMVE

SEQ ID NO: 2056 - protein, 15 aa, Blattella germanica
VEALFLLMKADPSIH

SEQ ID NO: 2057 - protein, 15 aa, Blattella germanica
DPSIHVLKMVAELTH

SEQ ID NO: 2058 - protein, 15 aa, Blattella germanica
PKSMLLNIFTNNLGR

SEQ ID NO: 2059 - protein, 15 aa, Blattella germanica
LNIFTNNLGRINTHV

SEQ ID NO: 2060 - protein, 15 aa, Blattella germanica
KTLVKFVEGNLKYFN

SEQ ID NO: 2061 - protein, 15 aa, Blattella germanica
LKYFNMGVQKFWAFD

SEQ ID NO: 2062 - protein, 15 aa, Blattella germanica
MGVQKFWAFDNTTFS

SEQ ID NO: 2063 - protein, 15 aa, Blattella germanica
NASAVIQEFLKTYKK

SEQ ID NO: 2064 - protein, 15 aa, Blattella germanica
HTKLSSSSSITLTLP

SEQ ID NO: 2065 - protein, 15 aa, Blattella germanica
SVNATVVRLQSWQSE

SEQ ID NO: 2066 - protein, 15 aa, Blattella germanica
VVRLQSWQSEMLRMN

SEQ ID NO: 2067 - protein, 15 aa, Blattella germanica
PRHGEQFYYFYQQIY

SEQ ID NO: 2068 - protein, 15 aa, Blattella germanica
DYQSYRTLMRKVYDA

SEQ ID NO: 2069 - protein, 15 aa, Blattella germanica
GQEYTFYVIVTPYAK

SEQ ID NO: 2070 - protein, 15 aa, Blattella germanica
KAIFIKCDVTNIPEF

SEQ ID NO: 2071 - protein, 15 aa, Blattella germanica
IVINNAGILNDEKWE

SEQ ID NO: 2072 - protein, 15 aa, Blattella germanica
KEFANVVRVVRHTSK

SEQ ID NO: 2073 - protein, 15 aa, Blattella germanica
RIKAFLALVECPCNK

SEQ ID NO: 2074 - protein, 15 aa, Blattella germanica
FRKFSNNFEFSYLLG

SEQ ID NO: 2075 - protein, 15 aa, Blattella germanica
NVIYSQNSFLPRATT

SEQ ID NO: 2076 - protein, 15 aa, Blattella germanica
RLFGAEVGWLALHHN

SEQ ID NO: 2077 - protein, 15 aa, Blattella germanica
LVYPTSLGFPLKLVL

SEQ ID NO: 2078 - protein, 15 aa, Blattella germanica
SHVHFRFVPSAAVEF

SEQ ID NO: 2079 - protein, 15 aa, Blattella germanica
KKLQFTYSESLDLDD

SEQ ID NO: 2080 - protein, 15 aa, Blattella germanica
AQIQVVIHLDEQYIY

SEQ ID NO: 2081 - protein, 15 aa, Blattella germanica
GVTPVFYNMVKQGLV

SEQ ID NO: 2082 - protein, 15 aa, Blattella germanica
SEVTALNRQIGGTPI

SEQ ID NO: 2083 - protein, 15 aa, Blattella germanica
GKDYILRVSQLGHTV

SEQ ID NO: 2084 - protein, 15 aa, Blattella germanica
NAIEFLNNIHDLLGI

SEQ ID NO: 2085 - protein, 15 aa, Blattella germanica
IDDIIAILPVDDLYA

SEQ ID NO: 2086 - protein, 15 aa, Blattella germanica
LIPVDQIIAIATDYL

SEQ ID NO: 2087 - protein, 15 aa, Blattella germanica
QIIAIATDYLANDAE

SEQ ID NO: 2088 - protein, 15 aa, Blattella germanica
ATDYLANDAEVQAAV

SEQ ID NO: 2089 - protein, 15 aa, Blattella germanica
EYQNLIQKLKDKGVD

SEQ ID NO: 2090 - protein, 15 aa, Blattella germanica
IQKLKDKGVDVDHII

SEQ ID NO: 2091 - protein, 15 aa, Blattella germanica
DKGVDVDHIIELIHQ

SEQ ID NO: 2092 - protein, 15 aa, Blattella germanica
DTRGLPEDLQDFLAL

SEQ ID NO: 2093 - protein, 15 aa, Blattella germanica
LIPTDQVLAIAADYL

SEQ ID NO: 2094 - protein, 15 aa, Blattella germanica
QVLAIAADYLANDAE

SEQ ID NO: 2095 - protein, 15 aa, Blattella germanica
LKALFNEKLETSPDF

SEQ ID NO: 2096 - protein, 15 aa, Blattella germanica
EYLKSDEFETIVVTV

SEQ ID NO: 2097 - protein, 15 aa, Blattella germanica
DEFETIVVTVDSLPE

SEQ ID NO: 2098 - protein, 15 aa, Blattella germanica
IVVTVDSLPEFKNFL

SEQ ID NO: 2099 - protein, 15 aa, Blattella germanica
DDLQDFLALIPVDQI

SEQ ID NO: 2100 - protein, 15 aa, Blattella germanica
PVDQIIAIATDYLAN

SEQ ID NO: 2101 - protein, 15 aa, Blattella germanica
IAIATDYLANDAEVQ

SEQ ID NO: 2102 - protein, 15 aa, Blattella germanica
DYLANDAEVQAAVAY

SEQ ID NO: 2103 - protein, 15 aa, Blattella germanica
DAEVQAAVAYLQSDE

SEQ ID NO: 2104 - protein, 15 aa, Blattella germanica
AAVAYLQSDEFETIV

SEQ ID NO: 2105 - protein, 15 aa, Blattella germanica
VTLDALPELQNFLNF

SEQ ID NO: 2106 - protein, 15 aa, Blattella germanica
LPELQNFLNFLEANG

SEQ ID NO: 2107 - protein, 15 aa, Blattella germanica
HDLLGIPHIPVSGRK

SEQ ID NO: 2108 - protein, 15 aa, Blattella germanica
IPHIPVSGRKYHIRR

SEQ ID NO: 2109 - protein, 15 aa, Blattella germanica
VSGRKYHIRRGVGIT

SEQ ID NO: 2110 - protein, 15 aa, Blattella germanica
PIDQILAIAADYLAN

SEQ ID NO: 2111 - protein, 15 aa, Blattella germanica
DYLANDAEVQAAVEY

SEQ ID NO: 2112 - protein, 15 aa, Blattella germanica
VTVDSLPEFKNFLNF

SEQ ID NO: 2113 - protein, 15 aa, Blattella germanica
LQTNGLNAIEFINNI

SEQ ID NO: 2114 - protein, 15 aa, Blattella germanica
LNAIEFINNIHDLLG

SEQ ID NO: 2115 - protein, 15 aa, Blattella germanica
ATGRKHVRRGVGING

SEQ ID NO: 2116 - protein, 15 aa, Blattella germanica
HVRRGVGINGLIDDV

SEQ ID NO: 2117 - protein, 15 aa, Blattella germanica
VGINGLIDDVIAILP

SEQ ID NO: 2118 - protein, 15 aa, Blattella germanica
IAILPVDELYALFQE

SEQ ID NO: 2119 - protein, 15 aa, Blattella germanica
KLESSPEFKALYDAI

SEQ ID NO: 2120 - protein, 15 aa, Blattella germanica
PEFKALYDAIRSPEF

SEQ ID NO: 2121 - protein, 15 aa, Blattella germanica
LYDAIRSPEFQSIVQ

SEQ ID NO: 2122 - protein, 15 aa, Blattella germanica
RSPEFQSIVQTLKAM

SEQ ID NO: 2123 - protein, 15 aa, Blattella germanica
QSIVQTLKAMPEYQD

SEQ ID NO: 2124 - protein, 15 aa, Blattella germanica
TLKAMPEYQDLIQRL

SEQ ID NO: 2125 - protein, 15 aa, Blattella germanica
IHENLIVTSPFRPWW

SEQ ID NO: 2126 - protein, 15 aa, Blattella germanica
FRPWWERYQLVSYNL

SEQ ID NO: 2127 - protein, 15 aa, Blattella germanica
ERYQLVSYNLNSRSG

SEQ ID NO: 2128 - protein, 15 aa, Blattella germanica
RCNNVGIRIYVDVVL

SEQ ID NO: 2129 - protein, 15 aa, Blattella germanica
GIRIYVDVVLNQMSG

SEQ ID NO: 2130 - protein, 15 aa, Blattella germanica
RGNNAIKWLVNFGVG

SEQ ID NO: 2131 - protein, 15 aa, Blattella germanica
GASILTYKTSKLYKM

SEQ ID NO: 2132 - protein, 15 aa, Blattella germanica
KLYKMAVAFMLAYPY

SEQ ID NO: 2133 - protein, 15 aa, Blattella germanica
WVCEHRWRQIFNMVG

SEQ ID NO: 2134 - protein, 15 aa, Blattella germanica
RWRQIFNMVGFRNAV

SEQ ID NO: 2135 - protein, 15 aa, Blattella germanica
LTVFDSTSCNVVVAS

SEQ ID NO: 2136 - protein, 15 aa, Blattella germanica
STSCNVVVASQECVG

SEQ ID NO: 2137 - protein, 15 aa, Blattella germanica
GRGIEDSLTISNLTT

SEQ ID NO: 2138 - protein, 15 aa, Blattella germanica
SQQDIVLADELSQEV

SEQ ID NO: 2139 - protein, 15 aa, Blattella germanica
AVLALCATDTLANED

SEQ ID NO: 2140 - protein, 15 aa, Blattella germanica
CATDTLANEDCFRHE

SEQ ID NO: 2141 - protein, 15 aa, Blattella germanica
LANEDCFRHESLVPN

SEQ ID NO: 2142 - protein, 15 aa, Blattella germanica
PYSVLATDYENYAIV

SEQ ID NO: 2143 - protein, 15 aa, Blattella germanica
VNQHKKAIEEDLKHF

SEQ ID NO: 2144 - protein, 15 aa, Blattella germanica
KHFNLKYEDLHSTCH

SEQ ID NO: 2145 - protein, 15 aa, Blattella germanica
MAPSYKLTYCPVKAL

SEQ ID NO: 2146 - protein, 15 aa, Blattella germanica
KLTYCPVKALGEPIR

SEQ ID NO: 2147 - protein, 15 aa, Blattella germanica
FLLSYGEKDFEDYRF

SEQ ID NO: 2148 - protein, 15 aa, Blattella germanica
GEKDFEDYRFQEGDW

SEQ ID NO: 2149 - protein, 15 aa, Blattella germanica
PNLKPSMPFGKTPVL

SEQ ID NO: 2150 - protein, 15 aa, Blattella germanica
QTHQSVAISRYLGKQ

SEQ ID NO: 2151 - protein, 15 aa, Blattella germanica
VAISRYLGKQFGLSG

SEQ ID NO: 2152 - protein, 15 aa, Blattella germanica
YLGKQFGLSGKDDWE

SEQ ID NO: 2153 - protein, 15 aa, Blattella germanica
KDDWENLEIDMIVDT

SEQ ID NO: 2154 - protein, 15 aa, Blattella germanica
NLEIDMIVDTISDFR

SEQ ID NO: 2155 - protein, 15 aa, Blattella germanica
MIVDTISDFRAAIAN

SEQ ID NO: 2156 - protein, 15 aa, Blattella germanica
ISDFRAAIANYHYDA

SEQ ID NO: 2157 - protein, 15 aa, Blattella germanica
AAIANYHYDADENSK

SEQ ID NO: 2158 - protein, 15 aa, Blattella germanica
YHYDADENSKQKKWD

SEQ ID NO: 2159 - protein, 15 aa, Blattella germanica
EVVKANGGYLAAGKL

SEQ ID NO: 2160 - protein, 15 aa, Blattella germanica
NGGYLAAGKLTWADF

SEQ ID NO: 2161 - protein, 15 aa, Blattella germanica
AAGKLTWADFYFVAI

SEQ ID NO: 2162 - protein, 15 aa, Blattella germanica
HMAKEDLVANQPNLK

SEQ ID NO: 2163 - protein, 15 aa, Blattella germanica
DLVANQPNLKALREK

SEQ ID NO: 2164 - protein, 15 aa, Blattella germanica
AAKFIIEEDSEAMEK

SEQ ID NO: 2165 - protein, 15 aa, Blattella germanica
IEEDSEAMEKELREA

SEQ ID NO: 2166 - protein, 15 aa, Blattella germanica
EAMEKELREAFRLYD

SEQ ID NO: 2167 - protein, 15 aa, Blattella germanica
ELREAFRLYDKEGNG

SEQ ID NO: 2168 - protein, 15 aa, Blattella germanica
FRLYDKEGNGYIPTS

SEQ ID NO: 2169 - protein, 15 aa, Blattella germanica
KEGNGYIPTSCLREI

SEQ ID NO: 2170 - protein, 15 aa, Blattella germanica
YIPTSCLREILRELD

SEQ ID NO: 2171 - protein, 15 aa, Blattella germanica
DELDMMIEEIDADGS

SEQ ID NO: 2172 - protein, 15 aa, Blattella germanica
KALQNAESEVAALNR

SEQ ID NO: 2173 - protein, 15 aa, Blattella germanica
RSEERLATATAKLAE

SEQ ID NO: 2174 - protein, 15 aa, Blattella germanica
VQKLQKEVDRLEDEL

SEQ ID NO: 2175 - protein, 15 aa, Blattella germanica
KEVDRLEDELVHEKE

SEQ ID NO: 2176 - protein, 15 aa, Blattella germanica
EAGFAKLAASDSKSL

SEQ ID NO: 2177 - protein, 15 aa, Blattella germanica
KLAASDSKSLLRKYL

SEQ ID NO: 2178 - protein, 15 aa, Blattella germanica
RCGRSMQGYPFNPCL

SEQ ID NO: 2179 - protein, 15 aa, Blattella germanica
LIDDHFLFKEGDRFL

SEQ ID NO: 2180 - protein, 15 aa, Blattella germanica
FLFKEGDRFLQHANA

SEQ ID NO: 2181 - protein, 15 aa, Blattella germanica
WCNEEDHLRIISMQM

SEQ ID NO: 2182 - protein, 15 aa, Blattella germanica
QVYRRLVTAVNDIEK

SEQ ID NO: 2183 - protein, 15 aa, Blattella germanica
RVPFSHDDRLGFLTF

SEQ ID NO: 2184 - protein, 15 aa, Blattella germanica
HDDRLGFLTFCPTNL

SEQ ID NO: 2185 - protein, 15 aa, Blattella germanica
CPTNLGTTVRASVRI

SEQ ID NO: 2186 - protein, 15 aa, Blattella germanica
SPYFVTNTEKMITEF

SEQ ID NO: 2187 - protein, 15 aa, Blattella germanica
KIGEYKNMIAEGIID

SEQ ID NO: 2188 - protein, 15 aa, Blattella germanica
RHNSAYKLHFNAFEY

SEQ ID NO: 2189 - protein, 15 aa, Blattella germanica
STSLVKAHSMRNSAS

SEQ ID NO: 2190 - protein, 15 aa, Blattella germanica
AVRLSKDIAADLQGE

SEQ ID NO: 2191 - protein, 15 aa, Blattella germanica
LVRLLKQLKVSQIME

SEQ ID NO: 2192 - protein, 15 aa, Blattella germanica
KQLKVSQIMEAARKL

SEQ ID NO: 2193 - protein, 15 aa, Blattella germanica
QQFISSEMVEPKEAS

SEQ ID NO: 2194 - protein, 15 aa, Blattella germanica
KNMTYVNTSLVLAFS

SEQ ID NO: 2195 - protein, 15 aa, Blattella germanica
QKGYMVSSMTDLWEA

SEQ ID NO: 2196 - protein, 15 aa, Blattella germanica
NTTFSNASAVIQEFL

SEQ ID NO: 2197 - protein, 15 aa, Blattella germanica
PAYFKMNSPSLWKYN

SEQ ID NO: 2198 - protein, 15 aa, Blattella germanica
MNITGSINLMFSQMY

SEQ ID NO: 2199 - protein, 15 aa, Blattella germanica
SINLMFSQMYHAQLA

SEQ ID NO: 2200 - protein, 15 aa, Blattella germanica
FSQMYHAQLAFSTAF

SEQ ID NO: 2201 - protein, 15 aa, Blattella germanica
FQINLDFKNHNGFIR

SEQ ID NO: 2202 - protein, 15 aa, Blattella germanica
DVLQWQTIPYTTIHN

SEQ ID NO: 2203 - protein, 15 aa, Blattella germanica
VPIMNIYSAFEFDPN

SEQ ID NO: 2204 - protein, 15 aa, Blattella germanica
LRLSEHLDYVKNLTV

SEQ ID NO: 2205 - protein, 15 aa, Blattella germanica
AKRFAKWALPLYNKP

SEQ ID NO: 2206 - protein, 15 aa, Blattella germanica
HIVFPSYEIEMFYDG

SEQ ID NO: 2207 - protein, 15 aa, Blattella germanica
SYEIEMFYDGSRIMI

SEQ ID NO: 2208 - protein, 15 aa, Blattella germanica
RILLRLHRCFQVLGR

SEQ ID NO: 2209 - protein, 15 aa, Blattella germanica
IRHAILAAGDLYSRR

SEQ ID NO: 2210 - protein, 15 aa, Blattella germanica
QSYETKLLFDLFYYA

SEQ ID NO: 2211 - protein, 15 aa, Blattella germanica
KLLFDLFYYANDYDT

SEQ ID NO: 2212 - protein, 15 aa, Blattella germanica
HINEGQFLYALSSAL

SEQ ID NO: 2213 - protein, 15 aa, Blattella germanica
QFLYALSSALFQRED

SEQ ID NO: 2214 - protein, 15 aa, Blattella germanica
LNDYILPAPYEIYPW

SEQ ID NO: 2215 - protein, 15 aa, Blattella germanica
EIYPWLFVDSDVIQR

SEQ ID NO: 2216 - protein, 15 aa, Blattella germanica
LNTYYSYYYFNYPTF

SEQ ID NO: 2217 - protein, 15 aa, Blattella germanica
SYYYFNYPTFFNSTE

SEQ ID NO: 2218 - protein, 15 aa, Blattella germanica
DRRGEMFYYTRQQLY

SEQ ID NO: 2219 - protein, 15 aa, Blattella germanica
MFYYTRQQLYARYFL

SEQ ID NO: 2220 - protein, 15 aa, Blattella germanica
RQQLYARYFLERLSN

SEQ ID NO: 2221 - protein, 15 aa, Blattella germanica
ARYFLERLSNDLPDV

SEQ ID NO: 2222 - protein, 15 aa, Blattella germanica
QATDAYVRVFLGPKY

SEQ ID NO: 2223 - protein, 15 aa, Blattella germanica
KELVEKYGKGKAIFI

SEQ ID NO: 2224 - protein, 15 aa, Blattella germanica
EDAFKKAYNAFKSLD

SEQ ID NO: 2225 - protein, 15 aa, Blattella germanica
AKGMMHMIKKGANGS

SEQ ID NO: 2226 - protein, 15 aa, Blattella germanica
VYEVAIPDRLTLRVE

SEQ ID NO: 2227 - protein, 15 aa, Blattella germanica
QTLFLLLLLLAAVSA

SEQ ID NO: 2228 - protein, 15 aa, Blattella germanica
SLLLNGGCKVSNYDE

SEQ ID NO: 2229 - protein, 15 aa, Blattella germanica
EVKIVATLKALQNAH

SEQ ID NO: 2230 - protein, 15 aa, Blattella germanica
ISLEVLKNYQLDSEL

SEQ ID NO: 2231 - protein, 15 aa, Blattella germanica
LKNYQLDSELRIKAF

SEQ ID NO: 2232 - protein, 15 aa, Blattella germanica
QVGSFIVSYLRNLRA

SEQ ID NO: 2233 - protein, 15 aa, Blattella germanica
THQFNVAGSVTVDKT

SEQ ID NO: 2234 - protein, 15 aa, Blattella germanica
LNQEAHYQFDSIHKF

SEQ ID NO: 2235 - protein, 15 aa, Blattella germanica
HYQFDSIHKFEFASK

SEQ ID NO: 2236 - protein, 15 aa, Blattella germanica
KAAVHLLVAVKASKE

SEQ ID NO: 2237 - protein, 15 aa, Blattella germanica
WVPSKKCHLTNIACL

SEQ ID NO: 2238 - protein, 15 aa, Blattella germanica
KCHLTNIACLLHNKY

SEQ ID NO: 2239 - protein, 15 aa, Blattella germanica
DVLDIGGLKVQKQTF

SEQ ID NO: 2240 - protein, 15 aa, Blattella germanica
DRKMYWQFKMDKIQI

SEQ ID NO: 2241 - protein, 15 aa, Blattella germanica
GHSHFVSDVVLSSDG

SEQ ID NO: 2242 - protein, 15 aa, Blattella germanica
HGRTFSSLFQVANQY

SEQ ID NO: 2243 - protein, 15 aa, Blattella germanica
LLMKADPSIHVLKMV

SEQ ID NO: 2244 - protein, 15 aa, Blattella germanica
QVLSASQSAIKSAAN

SEQ ID NO: 2245 - protein, 15 aa, Blattella germanica
SKVHAIMNIGKECEN

SEQ ID NO: 2246 - protein, 15 aa, Blattella germanica
FKRRVYKVYDFVRTH

SEQ ID NO: 2247 - protein, 15 aa, Blattella germanica
EYFKVAFKPTSPVPN

SEQ ID NO: 2248 - protein, 15 aa, Blattella germanica
TFEIDANGILQVSAE

SEQ ID NO: 2249 - protein, 15 aa, Blattella germanica
NNFEFSYLLGGANVG

SEQ ID NO: 2250 - protein, 15 aa, Blattella germanica
KLDSGLVYNPQLFDA

SEQ ID NO: 2251 - protein, 15 aa, Blattella germanica
DLHVKGSQHVATVEL

SEQ ID NO: 2252 - protein, 15 aa, Blattella germanica
LDSKNVLSILNYKTE

SEQ ID NO: 2253 - protein, 15 aa, Blattella germanica
VLSILNYKTEVNVKG

SEQ ID NO: 2254 - protein, 15 aa, Blattella germanica
QTLFAGYFDNTIRVW

SEQ ID NO: 2255 - protein, 15 aa, Blattella germanica
VVFQQTKAIADKIKD

SEQ ID NO: 2256 - protein, 15 aa, Blattella germanica
WSKVVIAYEPVWAIG

SEQ ID NO: 2257 - protein, 15 aa, Blattella germanica
YWTIDFDIAVARVST

What is claimed is:

1. A pharmaceutical composition comprising: (a) a peptide consisting of an amino acid sequence selected from TIPYYTKKFDEVVKA (SEQ ID NO:1), HDDRLGFLTFCPTNL (SEQ ID NO:7), KNRTTIRGRTKFEGN (SEQ ID NO:8), DRKMYWQFKMDKIQI (SEQ ID NO:9), IRGRTKFEGNKFTID (SEQ ID NO:11), NDIEKRVPFSHDDRL (SEQ ID NO:12), VLEKLEAGFAKLAAS (SEQ ID NO:14), NYAIVEGCPAAANGH (SEQ ID NO:15), GIRIYVDVVLNQMSG (SEQ ID NO:16), RWRQIFNMVGFRNAV (SEQ ID NO:17), NIACLLHNKYDSTKS (SEQ ID NO:18), LNIFTNNLGRINTHV (SEQ ID NO:20), KTPVLEIDGKQTHQS (SEQ ID NO:21), PAYFKMNSPSLWKYN (SEQ ID NO:22), PKSMLLNIFTNNLGR (SEQ ID NO:23), and (b) an adjuvant.

2. The pharmaceutical composition of claim 1, further comprising a pharmaceutically acceptable carrier, diluent or excipient.

3. A method of modulating immune response against a Cockroach allergen in a subject, comprising administering to the subject an amount of the pharmaceutical composition of claim 1, sufficient to modulate the immune response against the Cockroach allergen in the subject.

4. The method of claim 3, wherein the method comprises inducing in the subject immunological tolerance to the Cockroach allergen.

5. A method of treating a Cockroach allergy in a subject, comprising administering an effective amount of the peptide of claim 1, wherein the peptide has been identified by a method comprising:
  i. contacting a cell from the subject with the peptide; and
  ii. determining if the peptide modulates immune activity of the contacted cell.

6. The method of claim 5, wherein the subject is a human.

* * * * *